(12) United States Patent
Wallace et al.

(10) Patent No.: US 11,007,261 B2
(45) Date of Patent: May 18, 2021

(54) COMPOSITIONS AND METHODS OF VACCINATION AGAINST DENGUE VIRUS IN CHILDREN AND YOUNG ADULTS

(71) Applicant: TAKEDA VACCINES, INC., Cambridge, MA (US)

(72) Inventors: Derek Wallace, Walchwil (CH); John Boslego, Bethesda, MD (US)

(73) Assignee: TAKEDA VACCINES, INC., Cambridge, MA (US)

( * ) Notice: Subject to any disclaimer, the term of this patent is extended or adjusted under 35 U.S.C. 154(b) by 0 days.

(21) Appl. No.: 16/093,385

(22) PCT Filed: Apr. 13, 2017

(86) PCT No.: PCT/IB2017/052160
§ 371 (c)(1),
(2) Date: Oct. 12, 2018

(87) PCT Pub. No.: WO2017/179017
PCT Pub. Date: Oct. 19, 2017

(65) Prior Publication Data
US 2019/0381163 A1  Dec. 19, 2019

Related U.S. Application Data

(60) Provisional application No. 62/322,167, filed on Apr. 13, 2016.

(51) Int. Cl.
*A61K 39/12* (2006.01)
*C12N 7/00* (2006.01)
*A61K 39/00* (2006.01)

(52) U.S. Cl.
CPC ...... *A61K 39/12* (2013.01); *A61K 2039/5254* (2013.01); *A61K 2039/545* (2013.01); *A61K 2039/55* (2013.01); *A61K 2039/70* (2013.01); *C12N 2770/24134* (2013.01)

(58) Field of Classification Search
None
See application file for complete search history.

(56) References Cited

FOREIGN PATENT DOCUMENTS

| WO | 2010141386 A1 | 12/2010 | |
|---|---|---|---|
| WO | WO-2013188315 A1 * | 12/2013 | ............. A61K 39/12 |
| WO | 2014016360 A1 | 1/2014 | |
| WO | 2014074912 A1 | 5/2014 | |
| WO | 2014093182 A1 | 6/2014 | |
| WO | 2014150939 A1 | 9/2014 | |
| WO | 2016034629 A1 | 3/2016 | |

OTHER PUBLICATIONS

Osorio et al., Vaccine, 2011, 29:7251-7260. (Year: 2011).*
Sirivichayakuk, Chukiat et al., "Safety and Immunogenicity of a Tetravalent Dengue Vaccine Candidate in Healthy Children and Adults in Dengue-Endemic Regions: A Randomized, Placebo-Controlled Phase 2 Study", Journal of Infectious Diseases, Advance Access published Feb. 9, 2016, pp. 1-11.
Baez-Llorens, Xavier et aL., "Safety and immunogenicity of one versus two doses of Takeda's tetravalent dengue vaccine in children in Asia and Latin America, interim results from a phase 2, randomised, placebo-controlled study", Lancet Infect Dis, vol. 17, Jun. 2017, pp. 615-625.
Chu, H. et al., "CD8+ T-cell Responses in Flavivirus-Naive Individuals Following Immunization with a Live-Attenuated Tetravalent Dengue Vaccine Candidate", The Journal of Infectious Diseases, Nov. 15, 2015, vol. 212, pp. 1618-1628.
Osorio, J. et al., "Efficacy of a Tetravalent Chimeric Dengue Vaccine (DENVax) in Cynomolgus Macaques", Am. J. Trop. Med. Hyg., 84(6), 2011, pp. 978-987—The American Society of Tropical Medicine and Hygiene.
Osorio, J. et al., "Safety and immunogenicity of a recombinant live attenuated tetravalent dengue vaccine (DENVax) in flavivirus-naive healthy adults in Colombia: a randomised, placebo-controlled, phase 1 study", Lancet Infectious Diseases, vol. 14, No. 9, Sep. 1, 2014, pp. 830-838, XP05551 7052.
Biswal, SH., MD, "Takeda's Tetravalent Dengue Vaccine (TDV) Candidate: An update", Asia Dengue Summit, Bangkok, Jan. 13, 2016, DEN-204.
Wallace, D. et al., "Takeda's dengue vaccine candidate in children: one or two doses?", 5th Pan American Dengue Reseearch Network Meeting, 2016, pp. 86, DEN-204.
Rupp, R. et al., "Safety and immunogenicity of different doses and schedules of a live attenuated tetravalent dengue vaccine (TDV) in healthy adults: A Phase 1b randomized study", Vaccine, vol. 33, No. 46, Nov. 1, 2015, pp. 6351-6359, XP055517032.
George, S. et al., "Safety and immunogenicity of a Live Attenuated Tetravalent Dengue Vaccine Candidate in Flavivirus-Naive Adults: A Randomized, Double-Blinded Phase 1 Clinical Trial", Journal of Infectious Diseases. JID, vol. 212, No. 7, Mar. 19, 2015, pp. 1032-1041, XP055517050.
Takeda Press Release: "Takeda Completes Enrollment of More Than 20,000 Children and Adolescents in Global Phase 3 Trial of Dengue Vaccine Candidate", Apr. 5, 2017, DEN-301.
Wallace, D., "Persistence of neutralizing antibodies one year after two doses of a candidate recombinant tetravalent lengue vaccine in subjects aged from 1.5 to 45 years", American Society of Tropical Medicine & Hygiene, Oct. 27, 2015, DEN-203.

* cited by examiner

*Primary Examiner* — Stacy B Chen
(74) *Attorney, Agent, or Firm* — Nath, Goldberg & Meyer; Joshua B. Goldberg; Scott H. Blackman

(57) ABSTRACT

Embodiments herein concern compositions, methods, and uses for inducing an immune response to all four dengue virus serotypes in a child or young adult from about 1 year to about 20 years of age. Some embodiments concern compositions that can include dengue virus chimeras that, either alone or in combination with other constructs, can be used in vaccine compositions against all four dengue virus serotypes. Compositions can include constructs of more than one serotypes of dengue virus, such as dengue-1 (DEN-1) virus, dengue-2 (DEN-2) virus, dengue-3 (DEN-3) virus and/or dengue-4 (DEN-4) virus, at various concentrations or ratios to improve protection from infection in children and young adults. In certain embodiments, viruses of the formulations are limited to dengue virus serotypes. Other embodiments concern methods of administering immunogenic compositions against dengue virus that can include chimeric dengue constructs and live, attenuated dengue viruses using single, dual or other regimens.

67 Claims, 20 Drawing Sheets

Specification includes a Sequence Listing.

| Serotype | Strain | virus origin | C57T 5'NCR | A524T prM-D29V | T900C* M (silent) | C2055T E (silent) | G2579A NS1-G53D | C4018T NS2A-L181 | A5270 NS3-E250V | T5547C NS3 (silent) | G6599C NS4A-G75A | C8571T NS5 (silent) |
|---|---|---|---|---|---|---|---|---|---|---|---|---|
| DENV-2 | 16681 | isolate from human | C | A | T | C | G | C | A | T | G | C |
| | PDK-53 | PDK cell pass of 16681 | T | T | .. | t | A | T | T/A mix | c | C | t |
| | PDK53-V(VV45R) | Recombinant PDK-53-V | T | T | c | t | A | T | T | c | C | C |
| | PDK53-E(VE48R) | Recombinant PDK-53-E | T | T | c | t | A | T | A | c | C | C |

Underlined Mutations: the 3 most important attenuation loci of PDK-53

Red font: PDK-53 specific sequence (change from 16681)

Bold font: Different nt sequence between PDK-53 and clone-derived V or E virus

* Engineered silent clone marker to differentiate original PDK-53 and recombinant (clone-derived) viruses

| Per dose | TDV-1 | TDV-2 | TDV-3 | TDV-4 | Total |
|---|---|---|---|---|---|
| TDV formulation (Plaque Forming Units) | $2 \times 10^4$ PFU | $5 \times 10^4$ PFU | $1 \times 10^5$ PFU | $3 \times 10^5$ PFU | $4.7 \times 10^5$ PFU |

*Dengue-naïve children/young adults at baseline and after receiving TDV (tetravalent)

*Dengue-naïve children/young adults at baseline and after receiving TDV (tetravalent)

COMPOSITIONS AND METHODS OF VACCINATION AGAINST DENGUE VIRUS IN CHILDREN AND YOUNG ADULTS

RELATED APPLICATIONS

This is a National Phase Application filed under 35 U.S.C. 371 as a national stage of PCT/IB2017/052160, filed Apr. 13, 2017, an application claiming the benefit of U.S. Provisional Application No. 62/322,167, filed Apr. 13, 2016, the content of each of which is hereby incorporated by reference in its entirety.

FIELD

Embodiments disclosed herein concern compositions, methods, and uses for inducing an immune response to all four dengue virus serotypes in a child or young adult from about 1 year old to about 20 years old. Some embodiments concern compositions that can include, but are not limited to, chimeric and non-chimeric flavivirus virus constructs that, either alone or in combination, can be used in a vaccine composition to induce an immune response against all four dengue virus serotypes. In certain embodiments, compositions can include constructs of more than one serotype of dengue virus, such as dengue-1 (DEN-1) virus, dengue-2 (DEN-2) virus, dengue-3 (DEN-3) virus and/or dengue-4 (DEN-4) virus, at various concentrations or ratios in order to improve protection from dengue infection in children and young adults. Other embodiments concern methods of administering vaccine compositions that can include chimeric dengue constructs and live, attenuated dengue viruses using single, dual or other regimens of administration.

The Sequence Listing submitted in text format (.txt) on Oct. 12, 2018, named "SequenceListing.txt", (created on Thursday, Apr. 13, 2017, (751 KB), is incorporated herein by reference.

BACKGROUND

Dengue fever is a mosquito-borne disease caused by infection from a dengue virus. Dengue virus infections can lead to debilitating and painful symptoms, including a sudden high fever, headaches, joint and muscle pain, nausea, vomiting and skin rashes. To date, four serotypes of dengue virus have been identified: dengue-1 (DEN-1), dengue-2 (DEN-2), or dengue-3 (DEN-3) in combination with dengue-4 (DEN-4). Other subtypes may be discovered in the future (e.g., DEN-5). Dengue virus serotypes 1-4 can also cause dengue hemorrhagic fever (DHF) and dengue shock syndrome (DSS). In the most severe cases, DHF and DSS can be life threatening. Dengue viruses cause 50-100 million cases of debilitating dengue fever, 500,000 cases of DHF/DSS, and more than 20,000 deaths each year, a large portion of which are children. To date, there is no effective vaccine to protect against dengue fever and no drug treatment for the disease. Mosquito control efforts have been ineffective in preventing dengue outbreaks in endemic areas or in preventing further geographic spread of the disease. It is estimated that 3.5 billion people are threatened by infection with dengue virus. In addition, dengue virus is a leading cause of fever in travelers to endemic areas, such as Asia, Central and South America, and the Caribbean. Additionally, DHF/DSS is a leading cause of serious illness and death among children in some Asian and Latin American countries.

All four dengue virus serotypes are endemic throughout the tropical regions of the world and constitute the most significant mosquito-borne viral threat to humans in tropical regions, worldwide. Dengue viruses are transmitted to humans primarily by *Aedes aegypti* mosquitoes. Infection with one dengue virus serotype results in life-long protection from re-infection by that serotype, but does not prevent secondary infection by one of the other three dengue virus serotypes. In fact, previous infection with one dengue virus serotype leads to an increased risk of severe disease (DHF/DSS) upon secondary infection with a different serotype. The development of an effective vaccine, especially in children and young adults, represents an important approach to the prevention and control of this global disease.

SUMMARY

Embodiments disclosed herein concern compositions, methods and uses of chimeric dengue virus constructs. In some embodiments, a composition can include chimeric dengue virus constructs having an attenuated dengue virus backbone with structural genes from at least one other dengue virus serotype alone or in combination with live, attenuated dengue viruses. Other embodiments concern at least one live, attenuated virus in combination with one or more chimeric dengue viruses containing structural elements against at least one additional dengue virus serotype. Other embodiments can include a composition of chimeric dengue viruses having a modified DEN-2 backbone (e.g., PDK-53 as a starting backbone in P1 (passage-1) and modified PDK-53 using passage variability and selection as indicated for P2, P3 . . . P8 . . . P10 etc.) and one or more structural components of DEN-1, DEN-2, DEN-3 or DEN-4. In some embodiments, an immunogenic composition can be generated where when introduced to a subject, the composition produces an immune response to one or more dengue viruses in the subject. Therefore, constructs contemplated herein can be generated and passaged and each of the passages provides an attenuated dengue virus contemplated of use in a pharmaceutically acceptable vaccine composition Embodiments disclosed herein concern compositions, methods, and uses for inducing an immune response to all four dengue virus serotypes in a child or young adult from about 1 year old to about 45 years of age. Current formulations are not effective against young children and there is an unmet need for dengue vaccines of use against dengue infection for all age groups. In accordance with these embodiments, compositions and methods disclosed herein are of use against children ages from about 1 to 20 years of age, from about 1 to 15 years of age, from about 1 to 11 years of age or from about 2 to about 9 years of age or from about 1 to about 5 years of age.

In certain embodiments, chimeric dengue virus constructs of dengue virus serotypes of use in vaccines can include passage 8 (P8) live, attenuated viruses or chimeric viruses having nucleic acid sequences identified by SEQ ID NOS: 1, 3, 5 and 7 or polypeptide sequences indicated by SEQ ID NOS: 2, 4, 6 and 8. It is contemplated herein that any of the passages for any of the live, attenuated viruses described herein can be used in an immunogenic composition to induce immune responses to the represented dengue virus serotype (e.g., serotypes 1-4). In accordance with these embodiments, an immunogenic composition that includes a P-8 isolated live, attenuated virus can be administered to a subject to induce an immunogenic response against one or more dengue virus serotypes depending on the construct selected. In addition, a live, attenuated virus can be combined with one or more of these chimeric viruses. This is contemplated for each of the live, attenuated viruses isolated/produced in each subsequent cell passages (e.g., African Green Monkey Vero cell production, hereinafter: Vero cells or other appropriate cell line). It is contemplated herein that any cell line (e.g., GMP approved) capable of producing dengue viruses is of use to passage any of the viral constructs at a manufacturing scale or as appropriate contemplated herein for subsequent use in a vaccine or immunogenic composition against Dengue virus.

In other embodiments, compositions contemplated herein can be combined with other immunogenic compositions against other Flaviviruses such as Zika virus, West Nile virus, Japanese encephalitis, St. Louis encephalitis virus, yellow fever virus or any other flavivirus chimeric construct and/or live, attenuated virus. In certain embodiments, a single composition can be used against multiple flaviviruses. In some embodiments, compositions disclosed herein may be able to induce an immune response against Zika virus even if a vaccine composition is limited to dengue virus constructs and live, attenuated dengue virus.

In certain embodiments, an immunogenic composition of the present invention can include chimeric dengue viruses against one or more of DEN-1, DEN-2, DEN-3 and/or DEN-4, alone or in combination with a live, attenuated dengue virus composition.

In other embodiments, a construct can include a construct having adaptive mutations in the structural or non-structural regions of the virus that increase growth or production without affecting attenuation or safety of the virus when introduced to a subject. In certain embodiments, any of the contemplated chimeric dengue virus constructs can include a live, attenuated DEN-2 virus having specific imitations used as a backbone where the live attenuated DEN-2 PDK virus can further include structural proteins of one or more of prM (premembrane) and E (envelope) structural proteins of the other dengue virus serotypes. In addition, a DEN-2 backbone can include additional mutations or reversions of mutations in order to enhance the immune response to a predetermine composition in a subject upon administration (e.g., chimeric Dengue virus 2/1, 2/3 or 2/4).

In some embodiments, structural protein genes can include prM and E genes of DEN-1, DEN-2, DEN-3 or DEN-4 on a DEN-2 backbone having one or two reversions to improve immunogenicity. For example, a dengue construct, in certain embodiments can include those constructs termed TDV-1-A, TDV-2-F, TDV-3-F, and TDV-4-F (see Example section) where the DEN-2 backbone has one or more reversions to wild-type DEN-2 (e.g., in the non-coding region (NCR) or a non-structural region (NS1 etc.) or additional mutations not found in the P1 or other previous passaged virus) from the DEN-2 live, attenuated virus previously demonstrated to be safe and effective to induce an immune response. The DEN-2 live, attenuated virus of the instant application is an improved version of the originally used DEN-2 live, attenuated virus. A chimeric construct of the some embodiments disclosed herein can include a modified attenuated DEN-2 PDK-53 backbone, having one or more structural proteins of the second dengue virus serotype wherein the structural proteins can include additional mutations to increase an immunogenic response to the chimeric construct. In some embodiments, certain mutations acquired by attenuated DEN-2 PDK-53 can be reverted back to a control or another amino acid to produce chimeric constructs different from the P1 construct which can result in increased immunogenicity, increased growth, increased plaque size without affecting vaccine safety and attenuation and may affect growth and/or replication of live attenuated virus.

In other embodiments, a live, attenuated DEN-2 genome can be used to generate chimeric constructs of dengue virus serotype 1 (DEN-1), dengue virus serotype 3 (DEN-3), and dengue virus serotype 4 (DEN-4) where one or more structural protein genes of the DEN-2 viral genome can be replaced by one or more structural protein genes of DEN-1, DEN-3 or DEN-4, respectively. In some embodiments, a structural protein can include C, prM or E protein of a third dengue virus. In certain embodiments, structural protein genes can include the prM and E genes of DEN-1, DEN-3 or DEN-4. In accordance with these embodiments, these chimeric viruses can express surface antigens of DEN-1, DEN-3 or DEN-4 while retaining the attenuation phenotypes of the parent attenuated DEN-2. Further, chimeric constructs disclosed herein of use for vaccines in children and young adults can include chimeric constructs of DEN-4, DEN-2, DEN-1, and DEN-3 expressing surface antigens of DEN-1, DEN-3 and DEN-4 using attenuated DEN-2 virus as a backbone.

In certain embodiments, compositions of the instant invention can include a composition that can include a single chimeric dengue virus construct disclosed herein and a pharmaceutically acceptable carrier or excipient. In other embodiments, compositions disclosed herein can include a two or more, or three or more chimeric dengue virus constructs, and a pharmaceutically acceptable carrier or excipient. In accordance with these embodiments, a one or more dengue virus chimeric constructs contemplated herein can be combined with one or more, live attenuated dengue viruses. In certain embodiments, a live, attenuated virus can be a live, attenuated DEN-2 virus wherein reversions to wild-type amino acids in the NCR, NS1 regions or other regions increase the immune response, increase viral growth or other improvement for an improved live, attenuated dengue virus construct of use in formulations disclosed herein.

In certain embodiments, live, attenuated dengue viruses can include mutations or substitutions for nucleotide 5'NCR-57-T, NS1-53-Asp, and NS3-250-Val, of the DENV-2, that can be shared by the common PDK-53 virus-specific genetic backgrounds of the four TDV construct viruses. Genetic sequences of three attenuation loci, as well as, the previously established in vitro and in vivo attenuation phenotypes of these vaccine candidates have been carefully monitored for the cGMP-manufactured TDV seeds. Disclosed herein are strategies used to generate master virus seeds (MVS) as well as other relevant passages of dengue viruses of use in the manufacture of dengue virus vaccine compositions. These MVS can be used for manufacture of clinical materials and ultimately commercial vaccine supplies.

In certain embodiments, immunogenic compositions can include trivalent or tetravalent formulations capable of inducing an immune response to at least three or all four dengue virus serotypes in children and young adults. For example, immunogenic compositions can include Pre-Master Virus Seed, Master Virus Seed (MVS), Working Virus Seed (WVS) and Bulk Virus Seed (BVS) constructs of each of the four dengue virus serotypes. In other embodiments, immunogenic compositions can include one or more polynucleotides having nucleic acid sequences encoding a modified live, attenuated dengue-2 virus serotype represented by SEQ ID NOs: 9 (Pre-Master), 11 (MVS), 13 (WVS) or 15 (BVS); a dengue-1/dengue-2 chimeric polynucleotide having a nucleic acid sequence encoding nonstructural proteins from a modified live, attenuated dengue-2 virus serotype and structural proteins from a dengue-1 virus serotype, represented by SEQ ID NOs: 1 (Pre-Master), 3 (MVS), 5 (WVS) or 7 (BVS); a dengue-3/dengue-2 chimeric polynucleotide having a nucleic acid sequence encoding nonstructural proteins from a modified live, attenuated dengue-2 virus serotype and structural proteins from a dengue-3 virus serotype, represented by SEQ ID NOs: 17 (Pre-Master), 19 (MVS), 21 (WVS) or 23 (BVS); and a dengue-4/dengue-2 chimeric polynucleotide having a nucleic acid sequence encoding nonstructural proteins from a modified live, attenuated dengue-2 virus serotype and structural proteins from a dengue-4 virus serotype represented, by SEQ ID NOs: 25 (Pre-Master), 27 (MVS), 29 (WVS) or 31 (BVS). Some embodiments disclose immunogenic compositions capable of eliciting an immune response against one, two, three or all four dengue virus serotypes in a child or young adult.

In certain embodiments, immunogenic compositions can include formulations wherein the concentration ratio of the polynucleotide encoding a modified, live attenuated dengue-2 virus serotype in the composition can be at least one half to one log plaque forming unit (PFU) lower than the log PFU of one or more of the dengue virus polynucleotides. In other embodiments, immunogenic compositions can include formulations wherein the concentration ratio of the polynucleotide encoding a modified, live attenuated dengue-2 virus serotype in the composition is at least one and one half or greater than two or three logs plaque forming unit (PFU) lower than the log PFU of one or more of the polynucleotides In certain embodiments, immunogenic compositions against dengue alone or in combination with other viral vaccines can be mixtures of polypeptides and polynucleotides. In accordance with these embodiments, immunogenic compositions can include polynucleotides described herein or other flavivirus polynucleotides with or without various polypeptides encoded by polynucleotides. For example, a polypeptide can include one that corresponds to the modified live, attenuated dengue-2 virus serotype represented by SEQ ID NOs: 10 (Pre-Master), 12 (MVS), 14 (WVS) or 16 (BVS); a polypeptide corresponding to the dengue-1/dengue-2 chimeric polynucleotide represented by SEQ ID NOs: 2 (Pre-Master), 4 (MVS). 6 (WVS) or 8 (BVS) a polypeptide corresponding to the dengue-3/dengue-2 chimeric polynucleotide represented by SEQ ID NOs: 18 (Pre-Master), 20 (MVS), 22 (WVS) or 24 (BVS); and a polypeptide corresponding to the dengue-4/dengue-2 chimeric polynucleotide represented by SEQ NOs: 26 (Pre-Master), 28 (MVS), 30 (WVS) or 32 (BVS).

In certain embodiments, immunogenic compositions disclosed herein can include polypeptides and/or polynucleotides at various concentration ratios, including a concentration ratio of a dengue-1/dengue-2 chimera, to a modified live, attenuated dengue-2 virus serotype, to a dengue-3/dengue-2 chimera, to a dengue-4/dengue-2 chimera of 4:4:5:5 log plaque forming units (PFU). In other embodiments, concentration ratios of a dengue-1/dengue-2 chimera, to a modified live, attenuated dengue-2 virus serotype, to a dengue-3/dengue-2 chimera, to a dengue-4/dengue-2 chimera can be about 5:4:5:5 log HU. Other ratios contemplated herein can include compositions where live, attenuated dengue-2 and/or dengue-1 chimeric viruses are reduced compared to at least one of dengue-3 or dengue-4 chimeras and/or dengue-1. In yet other embodiments, tetravalent formulation ratios can be about 5:3:5:5, 3:3:5:5, or any ratio having in certain examples lower live, attenuated dengue-2 or reduced representation or both live, attenuated dengue-2 and dengue-1/dengue-2 chimera in the formulation.

In other embodiments, compositions disclosed herein can be a pharmaceutical composition that includes one or more immunogenic composition disclosed herein and a pharmaceutically acceptable excipient. In certain embodiments, pharmaceutical compositions can include immunogenic compositions made up of live, attenuated dengue viruses and/or dengue chimeras having both polynucleotides and polypeptides directed against one or more dengue serotypes.

Other embodiments can include kits that having at least on immunogenic composition of the present disclosure and at least one container of use against dengue virus infection in children and young adults.

Certain embodiments include methods for immunizing children and young adults against at least one to all four dengue virus serotypes. Methods can include administering one or more doses of pharmaceutical compositions disclosed herein to a subject. In accordance with these embodiments, a ratio having these characterizations can include live, attenuated viruses and/or chimeras that induce an immune response to all four dengue virus serotypes in the subject.

In certain embodiments, methods can include administering an immunogenic composition to a child or young adult that includes one or more polypeptides encoded by the polynucleotides disclosed herein in addition to polynucleotides. Methods can include polypeptides that include one or more of a polypeptide represented by SEQ NOs: 10 (Pre-Master), 12 (MVS), 14 (WVS) or 16 (BVS); a polypeptide represented by SEQ ID NOs: 2 (Pre-Master), 4 (MVS), 6 (WVS) or 8 (BVS); a polypeptide represented by SEQ ID NOs: 18 (Pre-Master), 20 (MVS), 22 (WVS) or 24 (BVS); and a polypeptide represented by SEQ ID NOs: 26 (Pre-Master), 28 (MVS), 30 (WVS) or 32 (BVS). In certain embodiments, methods can include administering immunogenic compositions having all four dengue virus serotypes represented in the immunogenic compositions disclosed herein to subjects ranging from about 1 year to about 20 years of age and eliciting immune responses to all four dengue virus serotypes (tetravalent formulations) in the subject. In other embodiments, methods can include administering immunogenic compositions disclosed herein to subjects ranging from about 1 year to about 45 years of age.

In certain embodiments, methods can include administering one or more doses of tetravalent formulations of the present disclosure to a subject by any acceptable means, including for example, subcutaneously, intravenously, intradermally, transdermally, orally, via inhalation, intravaginally, topically, intranasally or rectally. In accordance with these embodiments, formulations disclosed herein can be administered in a single dose or in two or more doses to a subject. In some embodiments, immunogenic formulations disclosed herein can be administered within about 90 days of each other, within about 60 days of each other, within about 30 days of each other, and within less than about 30 days of each other. In some embodiments, immunogenic formulations disclosed herein can be administered to a child or young adult on day 0 and again around 3 months from the first administration.

In certain embodiments, tetravalent formulations disclosed herein can elicit immune responses against all four dengue virus serotypes in at least 60% of children and young adults having received one or more doses of tetravalent compositions.

BRIEF DESCRIPTION OF THE DRAWINGS

The following drawings form part of the present specification and are included to further demonstrate certain embodiments. Some embodiments may be better understood by reference to one or more of these drawings alone or in combination with the detailed description of specific embodiments presented.

Figure 1:
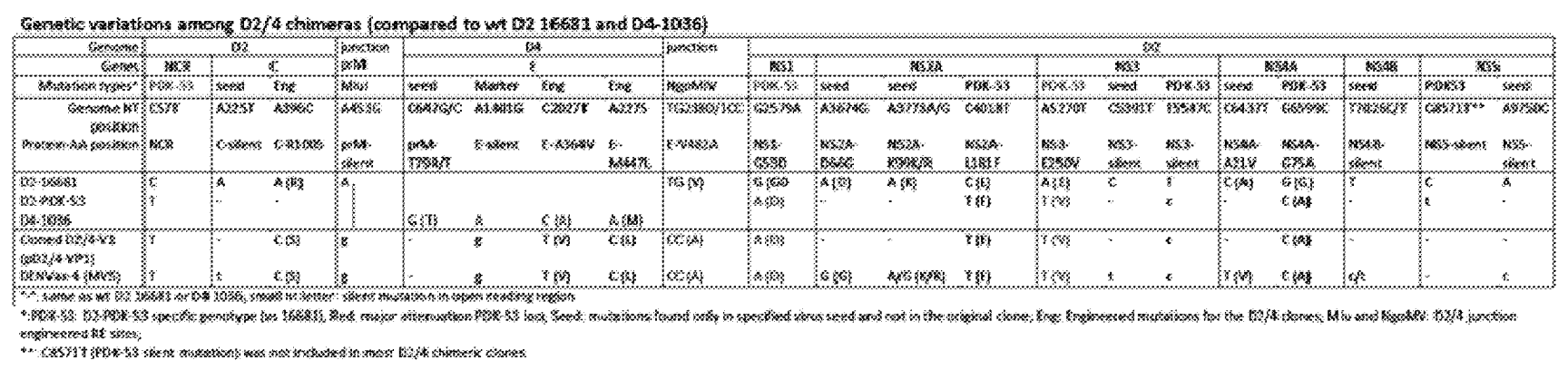

FIG. 1 represents an exemplary chart reflecting an exemplary chimeric construct of the instant invention, DEN-2/DEN-4 compared to previously generated constructs and wild type dengue viruses.

FIG. 2 represents an exemplary histogram plot comparing various responses using a live, attenuated DEN-2 backbone (with additional mutations) and a second dengue virus serotype as structural components substituted for the dengue-2 structural components (e.g., TDV-1 MVS). This plot illustrates plaque sizes of the TDV MVS. Wild-type Dengue viruses and previously published research-grade vaccine candidate viruses were included for control and comparison. This plot illustrates improved production of the dengue virus constructs compared to control dengue virus chimeric constructs.

FIG. 3 represents an exemplary histogram plot that represents temperature sensitivities of TDV MVS (Master Virus Seed, denoted here as DENVax). Wild type dengue viruses and previously published research-grade vaccine candidate viruses were included for comparison with the MVS grade.

FIG. 4 represents an exemplary histogram plot that represents viral growth of TDV (also known as DENVax) MVS in C6/36 cells compared to controls. Wild-type dengue viruses and research-grade vaccine candidate viruses were included for comparison with the TDV MVS (denoted here as DENVax).

Figures 5A, 5B, 5C:
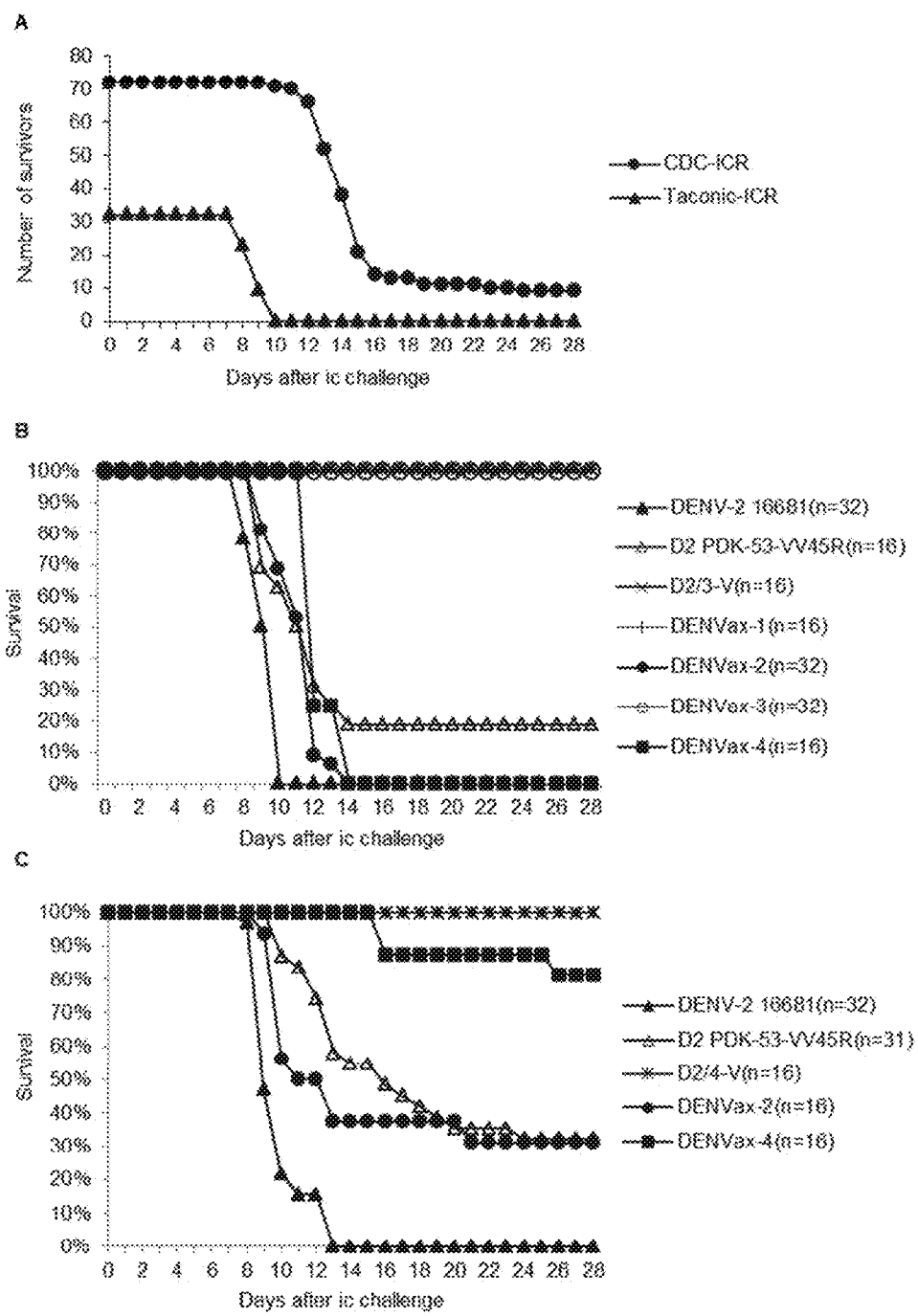

FIGS. 5A-5C represent exemplary plots of neurovirulence in newborn mice. Pooled results of several experiments summarizing the neurovirulence of wt DENV-2 16681 virus in CDC-ICR (n=72) and Taconic-ICR (n=32) newborn mice challenged ic with $10^4$ pfu of the virus (A). Neurovirulence of TDV MVS (Master Virus Seed, denoted here as DENVax) tested in Taconic-ICR mice with a dose of $10^4$ pfu (B) or $10^3$ pfu (C). The numbers of animals tested per group in one experiment (n=16) or two pooled experiments (n=31 or 32) are indicated.

Figure 6:
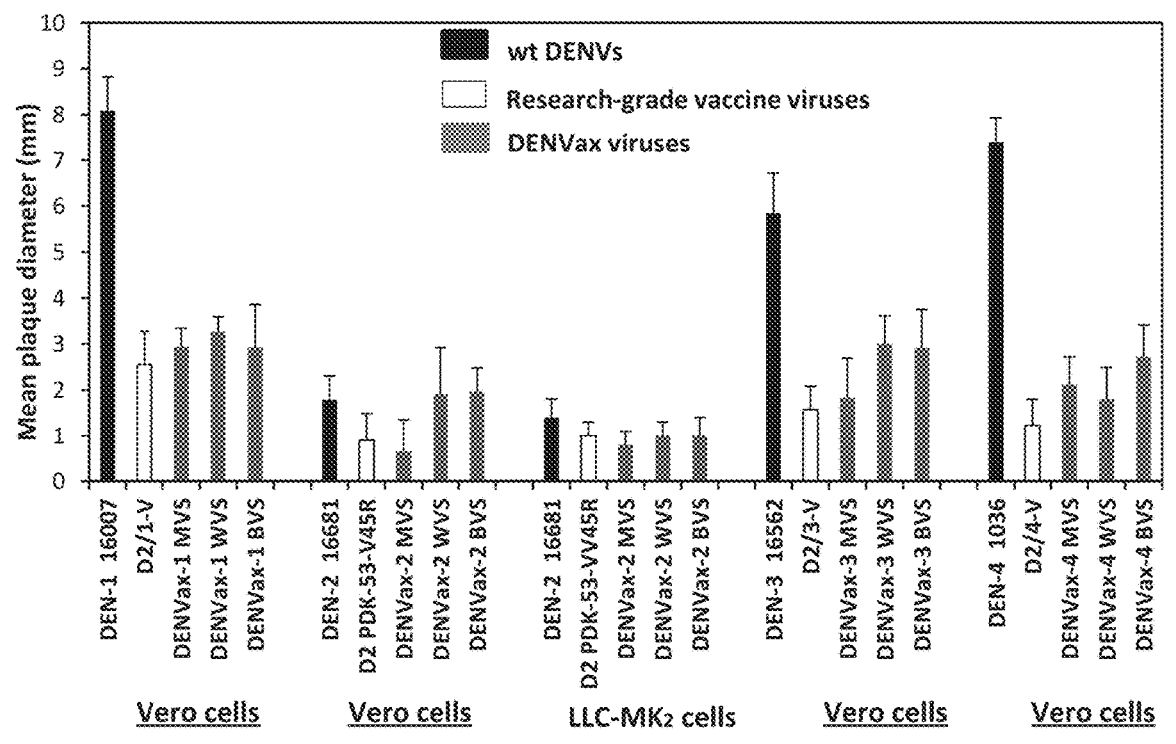

FIG. 6 represents an exemplary histogram illustrating plaque size of the TDV MVS, WVS, and BVS. Mean plaque diameters±SD (error bars) of the virus plaques in Vero or LLC-MK$_2$ cells under agarose overlay measured on day 9 pi. Wild type DENVs and previously published research-grade vaccine candidate viruses were included for control and comparison.

Figure 7:
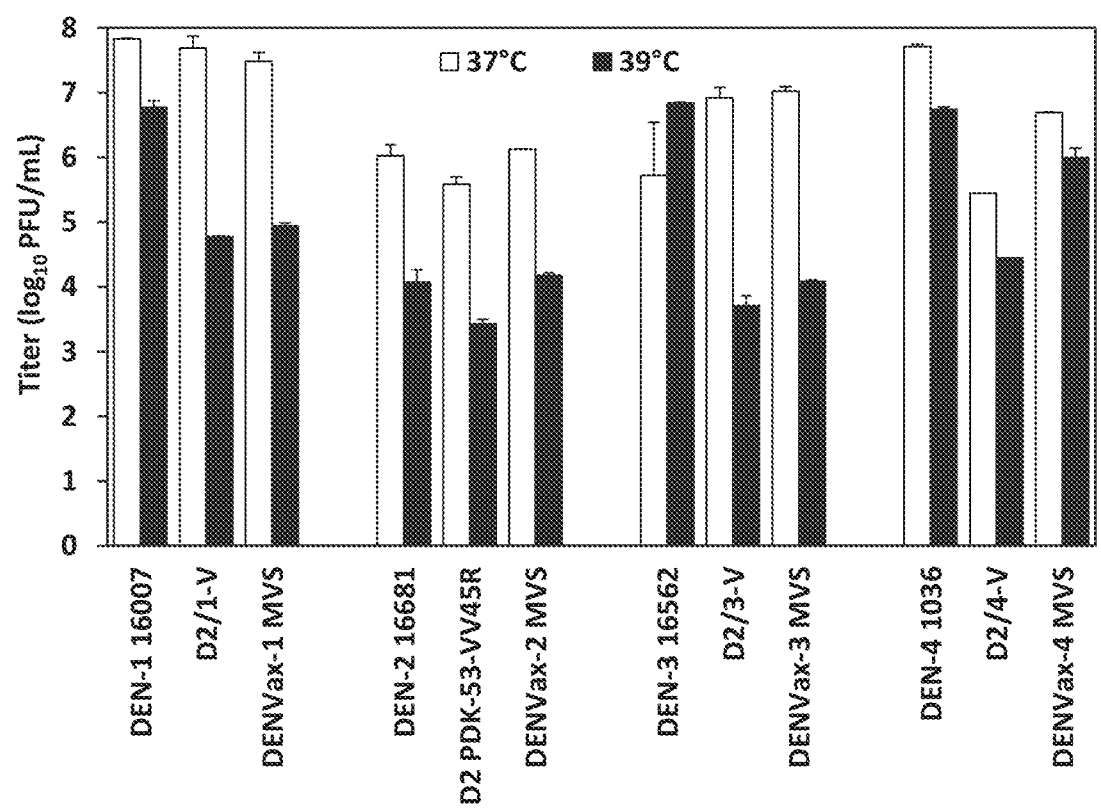

FIG. 7 represents an exemplary histogram plot illustrating growth of TDV (denoted here as DENVax) MSV, WVS, and BVS in C6/36 cells at two incubation temperatures to verify their retention of this in vitro attenuation marker after large scale manufacturing. Certain wild-type dengue viruses and previously published research-grade vaccine candidate viruses were included for comparison.

Figure 8:
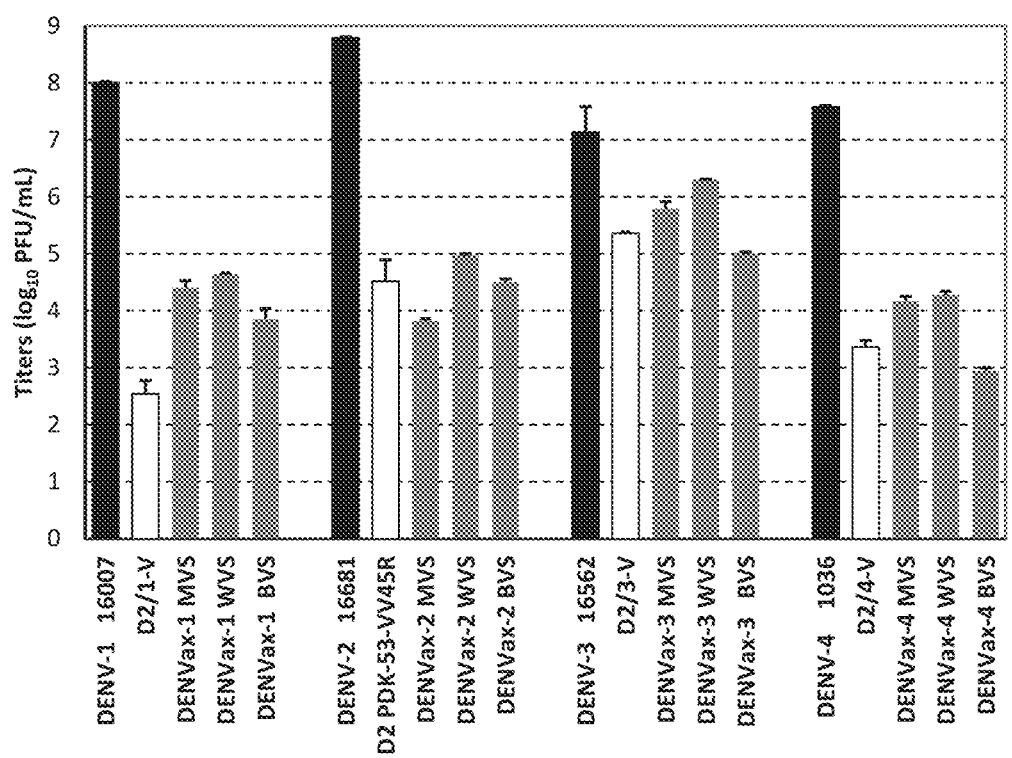

FIG. 8 represents an exemplary histogram plotting restricted growth of TDV MVS (Master Virus Seed, denoted here as DENVax), WVS, and BVS in C6/36 cells. Mean titers±SD (error bars) of the viruses replicated in C6136 cells 7 days pi. Certain wild-type dengue viruses and previously published research-grade vaccine candidate viruses were included for comparison.

Figure 9A:
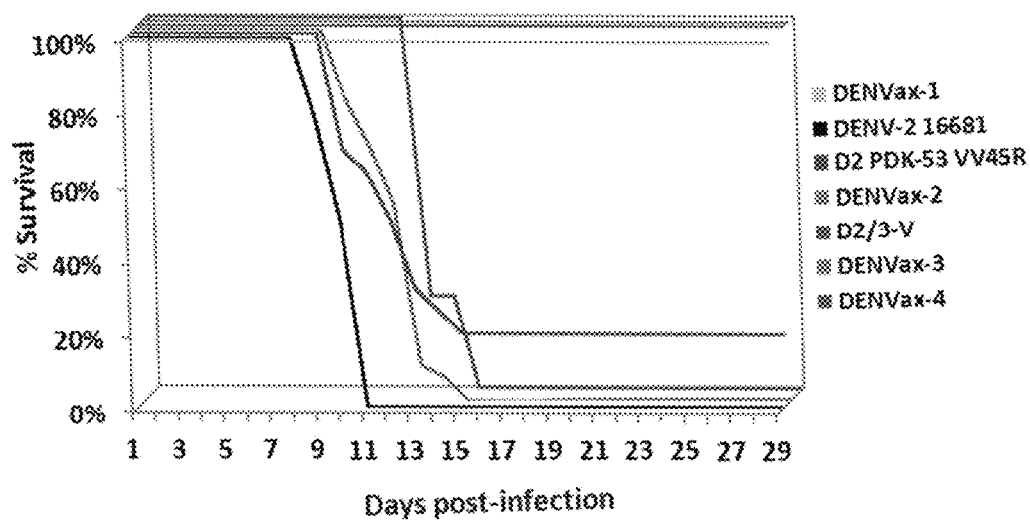
Figure 9B:
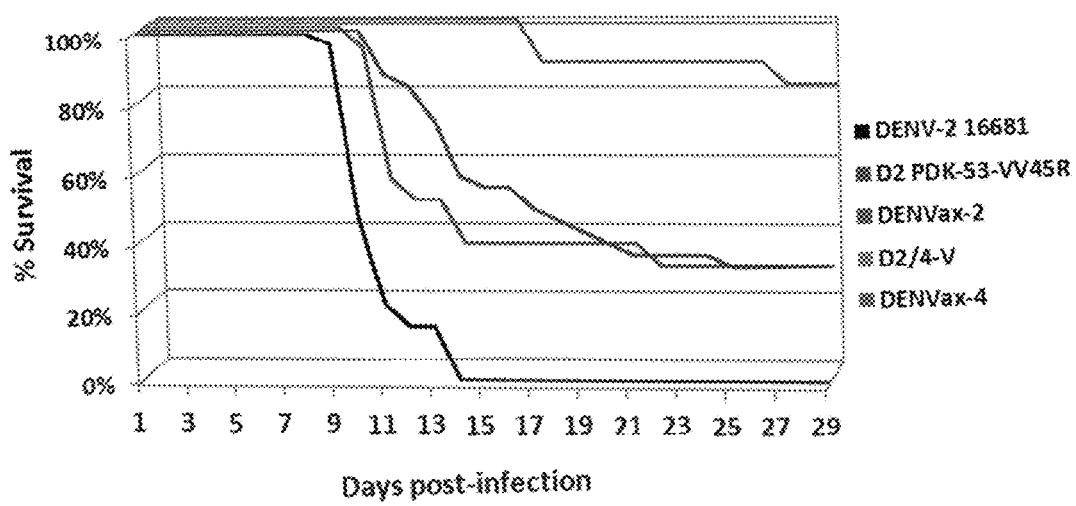

FIGS. 9A-9B represent exemplary graphs of data of neurovirulence of TDV MVS (Master Virus Seed, denoted here as DENVax) in newborn ICR mice. (A) IC inoculations of the virus at dose of $10^4$ PFU. (B) IC inoculation of the virus at dose of $10^3$ PFU.

FIG. 10 represents an exemplary chart comparing new live, attenuated dengue-2 viruses to previously generated live, attenuated dengue-2 viruses.

Figure 11A:
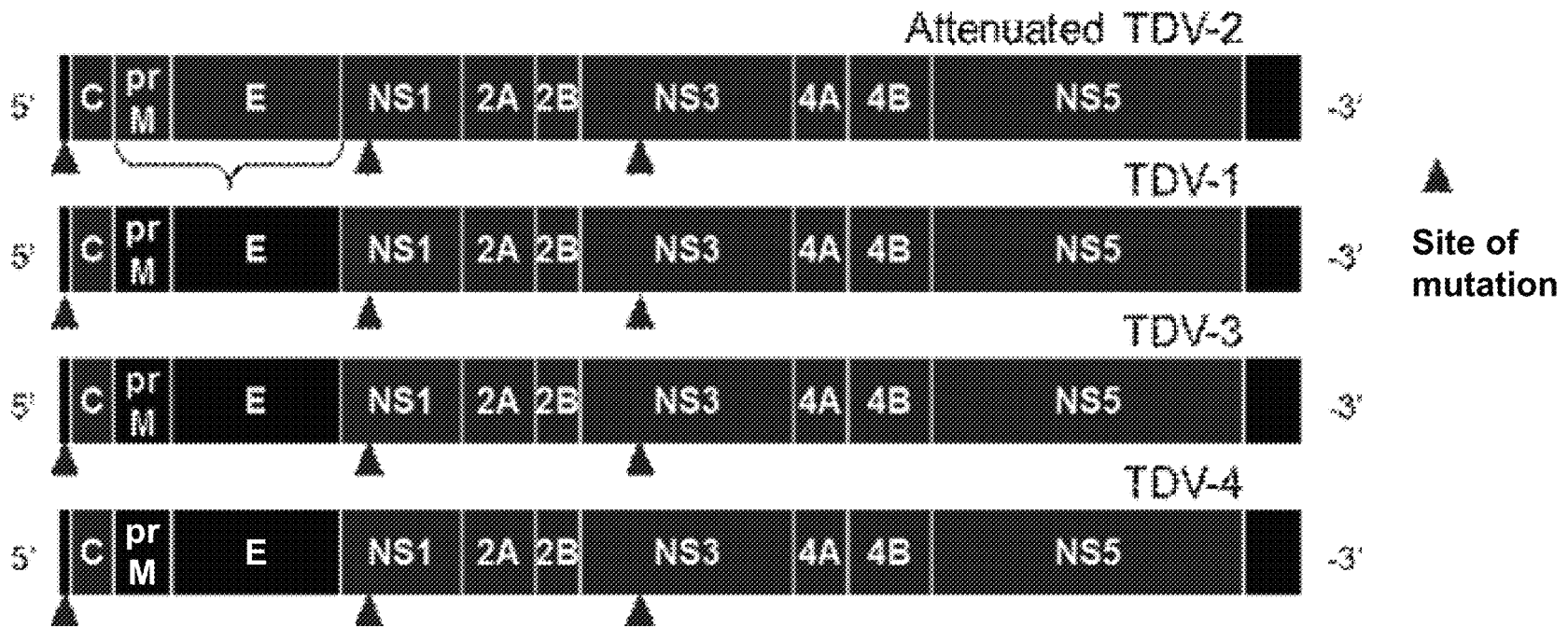

FIG. 11A is a representative diagram of live, attenuated dengue viruses and dengue-dengue chimeric constructs (denoted TDV) of the present disclosure, including representative protein domains and mutation sites.

FIG. 11B is a representative formulation of one tetravalent formulation, according to one embodiment of the present disclosure.

Figure 12A:
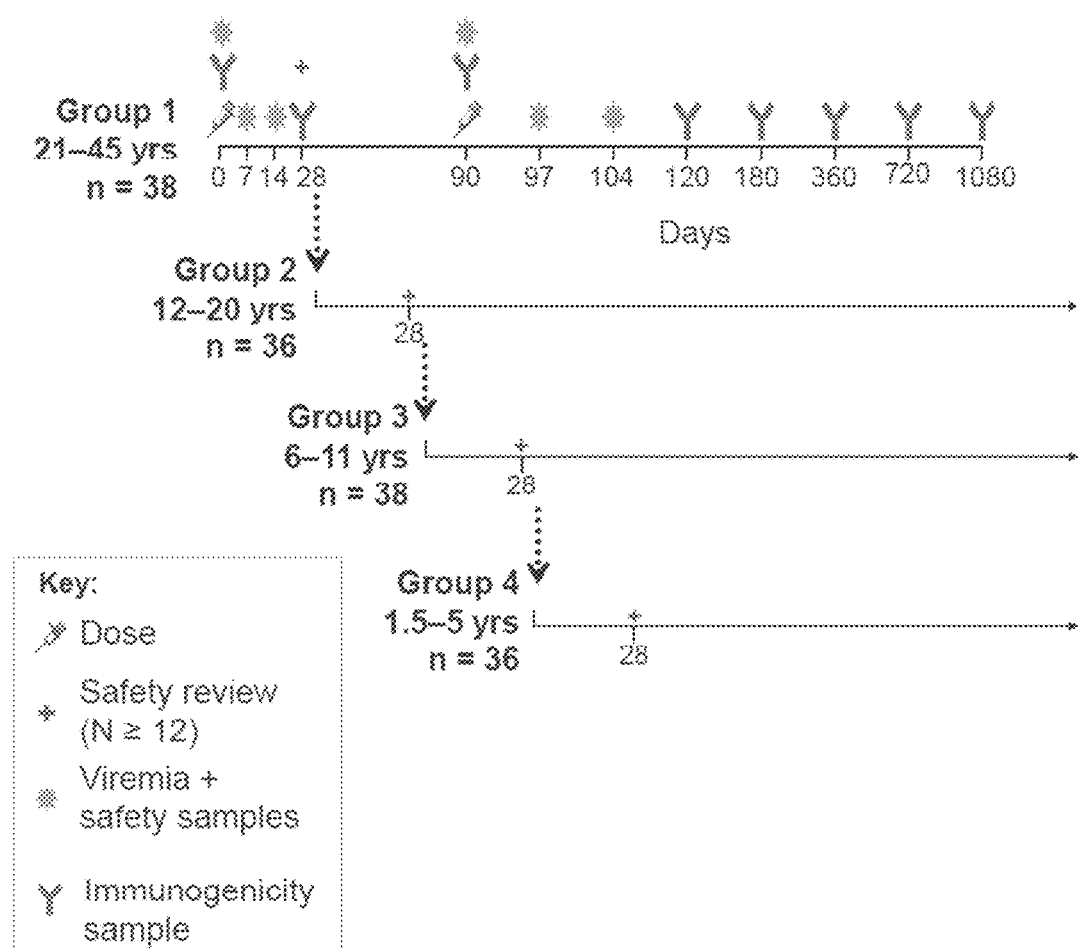

FIG. 12A is a representative diagram of a dosing regimen in subjects performed as part of a clinical trial, according to one embodiment of the present disclosure.

Figure 12B:
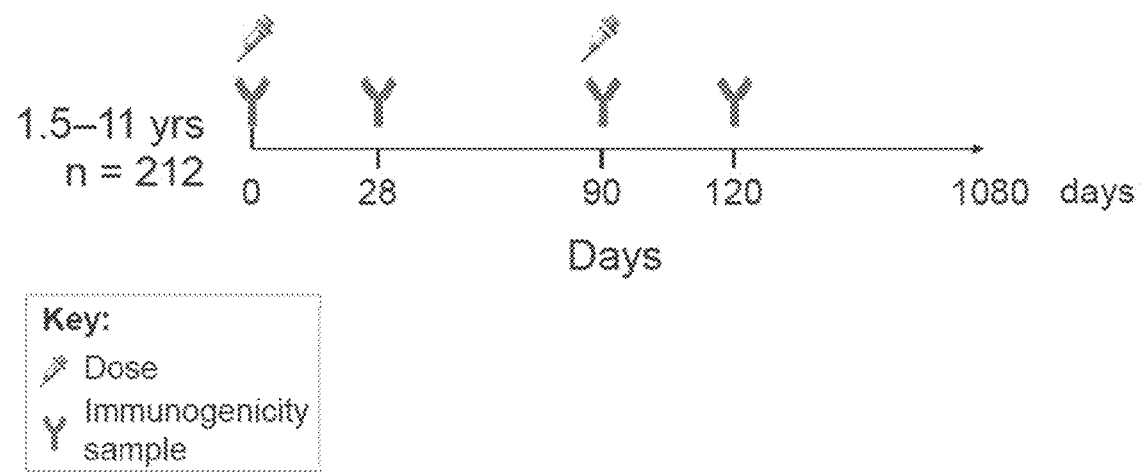

FIG. 12B is a representative diagram of a dosing regimen in subjects performed as part of a clinical trial, according to one embodiment of the present disclosure.

Figure 13A:
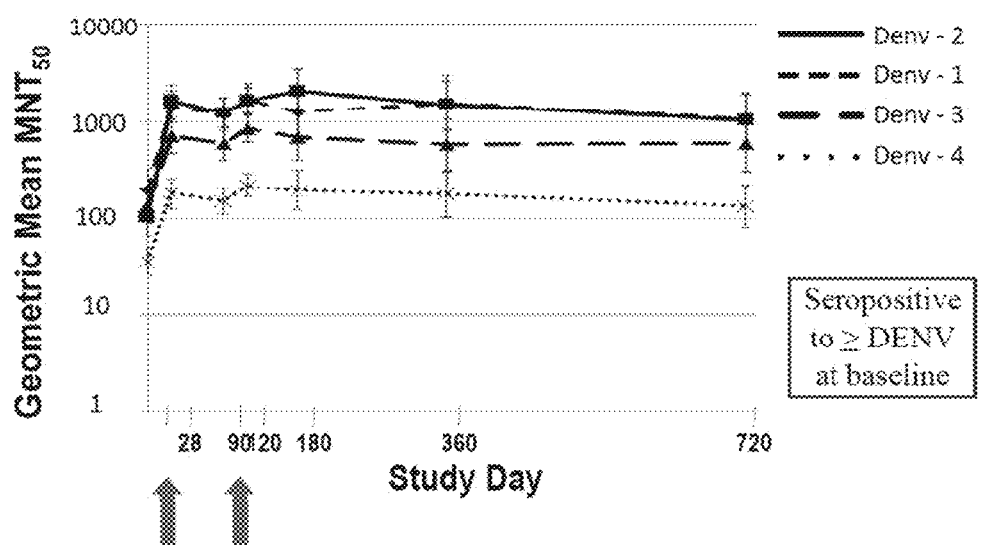

FIG. 13A is a representative line graph depicting results of microneutralization tests (MNTs) in which neutralizing antibody responses after tetravalent formulation administration to seropositive subjects, according to one embodiment of the present disclosure.

Figure 13B:
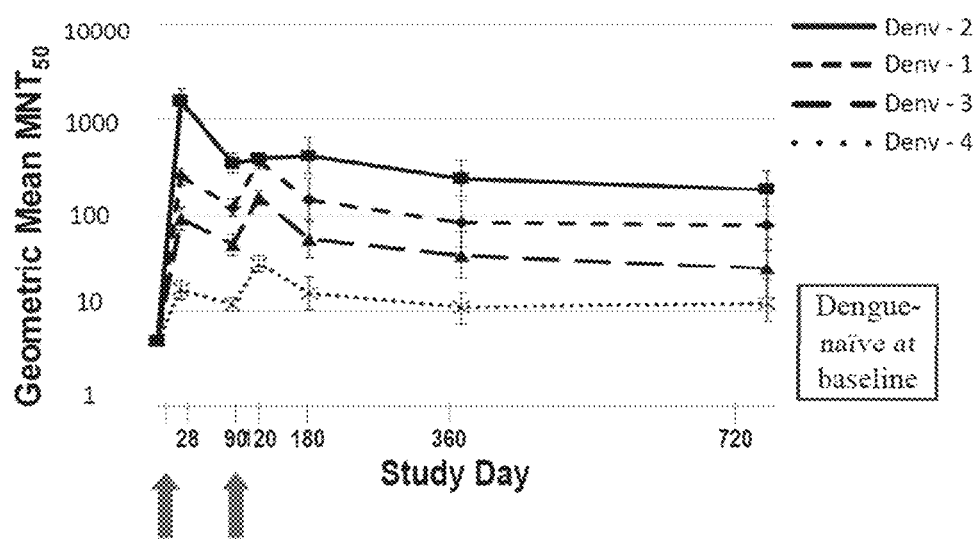

FIG. 13B is a representative line graph depicting results of microneutralization tests (MNTs) in which neutralizing antibody responses after tetravalent formulation administration to dengue-naïve subjects, according to one embodiment of the present disclosure.

Figure 14:
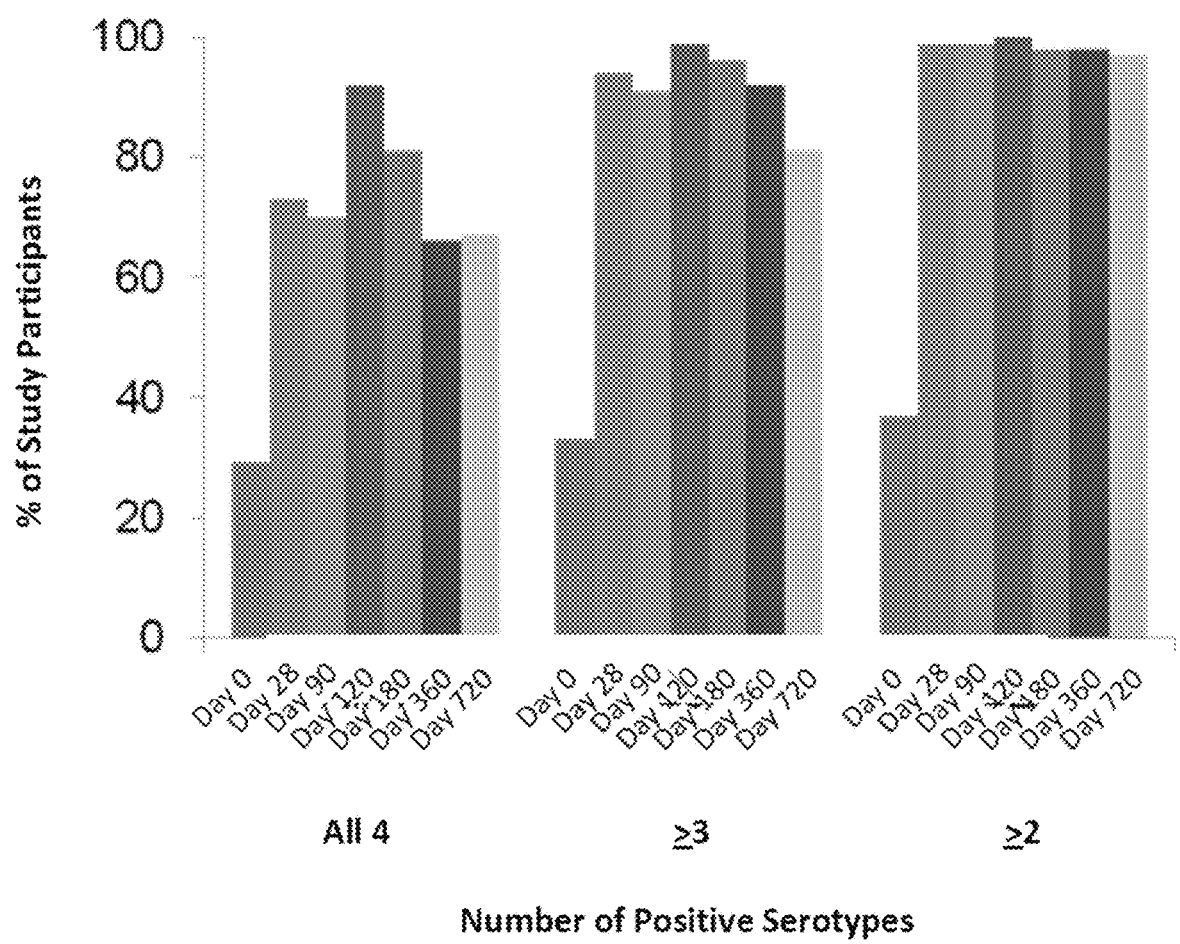

FIG. 14 is a representative bar graph depicting percentages of clinical trial subjects that are seropositive for all four dengue serotypes at various time points after tetravalent formulation administration, according to one embodiment of the present disclosure.

Figure 15:
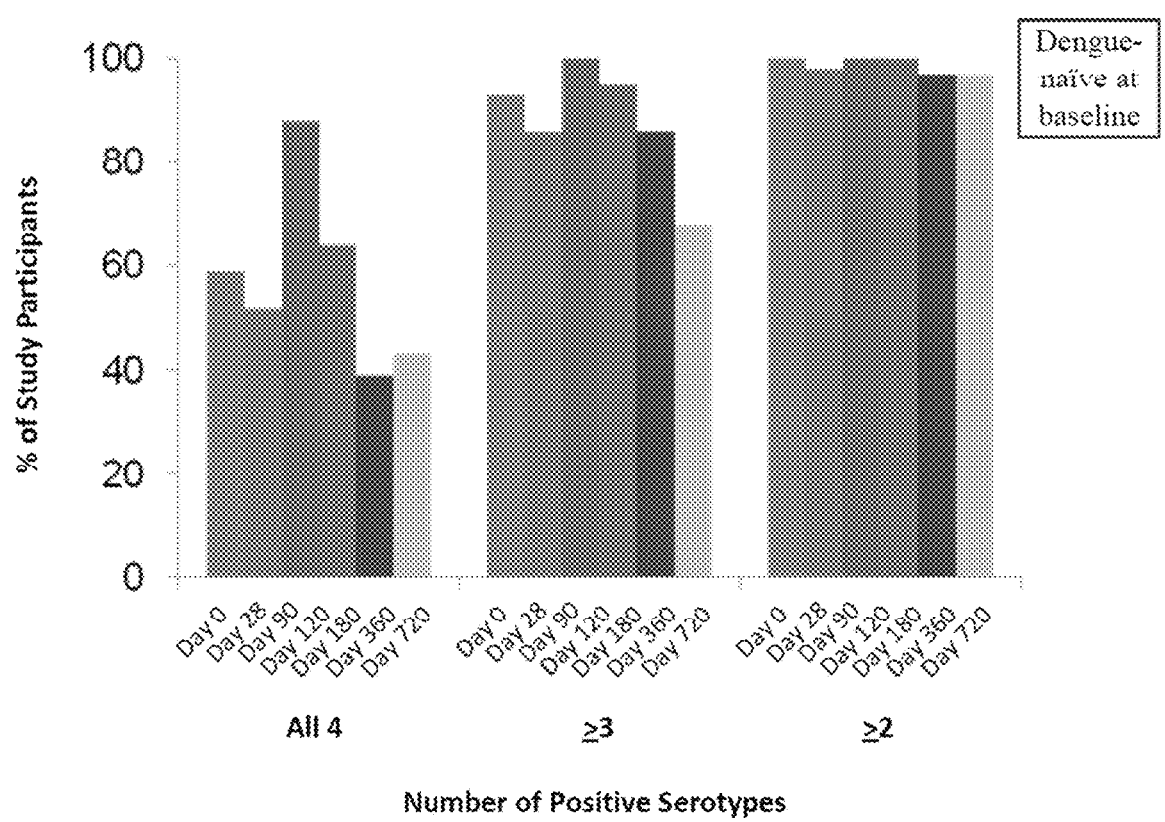

FIG. 15 is a representative bar graph depicting percentages of clinical trial subjects that are seropositive for all four dengue serotypes at various time points after tetravalent formulation administration, according to one embodiment of the present disclosure.

Figure 16:
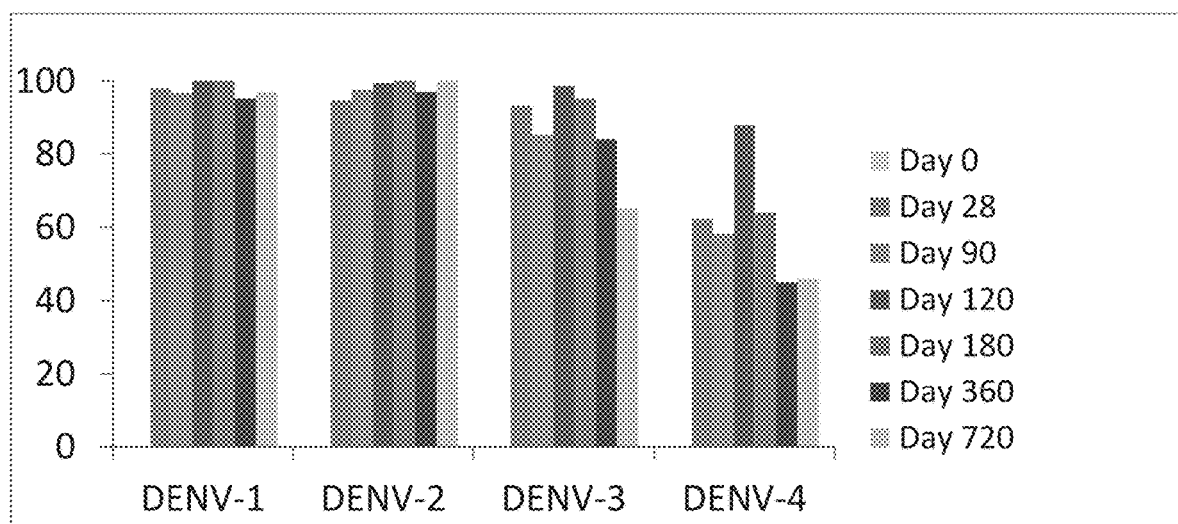

FIG. 16 is a representative bar graph depicting percentages of seropositive clinical trial subjects that were naïve before receiving a pharmaceutical composition of all four dengue serotypes at various time points after tetravalent formulation administration, according to one embodiment of the present disclosure.

Figure 17:
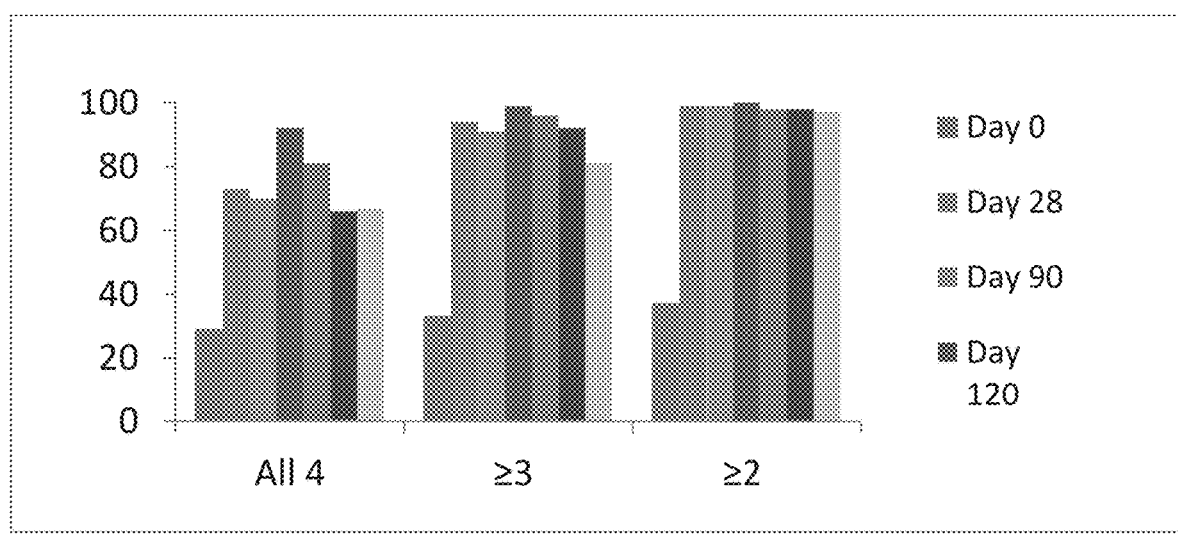

FIG. 17 is a representative bar graph depicting percentages of seropositive clinical trial subjects (children and adults) to multiple serotypes after receiving a pharmaceutical composition of all four dengue serotypes, according to one embodiment of the present disclosure.

DEFINITIONS

As used herein, "a" or "an" can mean one or more than one of an item.

As used herein the specification, "subject" or "subjects" can include, but are not limited to, mammals such as humans (e.g. children to adult) or mammals, domesticated or wild, for example dogs, cats, other household pets (e.g., hamster, guinea pig, mouse, rat), ferrets, rabbits, pigs, horses, cattle, prairie dogs, wild rodents, or zoo animals.

As used herein, the terms "virus chimera," "chimeric virus," "flavivirus chimera" and "chimeric flavivirus" can mean a construct comprising a portion of the nucleotide sequence of a dengue-2 virus and further nucleotide sequence that is not from dengue-2 virus or is from a different flavivirus. A "dengue chimera" comprises at least two different dengue virus serotypes but does not include a different flavivirus. Therefore, examples of other dengue viruses or flaviviruses can include, but are not limited to, sequences from dengue-1 virus, dengue-3 virus, dengue-4 virus, Zika virus, West Nile virus, Japanese encephalitis virus, St. Louis encephalitis virus, tick-borne encephalitis virus, yellow fever virus and any combination thereof.

As used herein, "nucleic acid chimera" can mean a construct of the present disclosure including a nucleic acid having a portion of the nucleotide sequence of a dengue virus (e.g. dengue-2 virus) and further nucleotide sequences that are not of the same origin as this dengue virus. In accordance with these embodiments, any chimeric dengue or flavivirus chimera disclosed herein can be recognized as an example of a nucleic acid chimera.

As used herein, "a live, attenuated virus" can mean a wild-type virus, mutated or selected for traits of use in vaccine or other immunogenic compositions wherein some traits can include reduced virulence, safety, efficacy or improved growth etc.

As used herein, "dengue virus formulations" or "immunogenic composition(s)" or "vaccine formulations" or pharmaceutical formulation thereof can include various combinations of polynucleotides and/or polypeptides disclosed herein, which can be administered to a subject and can elicit an immune response to one or more dengue virus serotypes in that subject.

Description

In the following sections, various exemplary compositions and methods are described in order to detail various embodiments. It will be obvious to one skilled in the art that practicing the various embodiments does not require the employment of all or even some of the specific details outlined herein, but rather that concentrations, times and other specific details may be modified through routine experimentation. In some cases, well-known methods or components have not been included in the description.

In accordance with embodiments of the present disclosure, there may be employed conventional molecular biology, protein chemistry, microbiology, and recombinant DNA techniques within the skill of the art. Such techniques are explained fully in the literature. See, e.g., Sambrook, Fritsch & Maniatis, Molecular Cloning: A Laboratory Manual, Second Edition 1989, Cold Spring Harbor Laboratory Press, Cold Spring Harbor, N.Y.; Animal Cell Culture, R. I. Freshney, ed., 1986).

Embodiments disclosed herein concern compositions, methods, and uses for inducing an immune response to one or up to all four dengue virus serotypes in a subject such as a child or young adult from about 1 year old to about 20 years old. Other embodiments concern compositions, methods and uses for inducing immune responses against one or more dengue virus serotypes in the subject, individually or simultaneously. In accordance with these embodiments, attenuated dengue viruses and nucleic acid chimeras can be generated and used in vaccine compositions disclosed herein. Some embodiments concern modified or mutated dengue constructs or chimeras. Other embodiments concern introducing mutations to modify the amino acid sequences of structural proteins of dengue viruses wherein the mutation increase immunogenicity to the virus.

Live, attenuated dengue viruses of all four serotypes have been developed by passaging wild-type viruses in cell culture. These are some of the most promising live, attenuated vaccine candidates for immunization against flavivirus and in particular dengue virus infection and/or disease. These vaccine candidates have been designated by a combination of their dengue serotype, the cell line through which they were passaged and the number of times they were passaged. Thus, a dengue serotype 1 wild-type virus passaged in PDK cells 13 times is designated as DEN-1 PDK-13 virus. Other vaccine candidates are DEN-2 PDK-53, DEN-3 PGMK-30/FRhL-3 (e.g., thirty passages in primary green monkey kidney cells, followed by three passages in fetal rhesus lung cells and DEN-4 PDK-48). These four candidate vaccine viruses were derived by tissue culture passage of wild-type parental DEN-1 16007, DEN-2 16681, DEN-3 16562 and DEN-4 1036 viruses, respectively.

DEN-2 PDK-53 virus vaccine candidate (hereinafter, PDK-53), has several measurable biological markers associated with attenuation, including temperature sensitivity, small plaque size, decreased replication in mosquito C6136 cell culture, decreased replication in intact mosquitoes, loss of neurovirulence for suckling mice and decreased incidence of viremia in monkeys. Clinical trials of the candidate PDK-53 vaccine have demonstrated its safety and immunogenicity in humans. Furthermore, the PDK-53 vaccine induces dengue virus-specific T-cell memory responses in human vaccine recipients. Some embodiments herein describe an improved DEN-2 PDK-53 used in chimeric constructs disclosed herein for inducing an immune response against dengue virus in children and young adults.

Immunogenic flavivirus chimeras having a dengue-2 virus backbone and at least one structural protein of another dengue virus serotype can be used for preparing the dengue virus chimeras and methods for producing the dengue virus chimeras are described. The immunogenic dengue virus chimeras are provided, alone or in combination, in a pharmaceutically acceptable carrier as immunogenic compositions to minimize, inhibit, or immunize individuals against infection by one or more serotypes, such as dengue virus serotypes DEN-1, DEN-2, DEN-3 and DEN-4, alone or in combination. When combined, the immunogenic dengue virus chimeras may be used as multivalent vaccines (e.g., bi-, tri- and tetravalent) to confer simultaneous protection against infection by more than one species or strain of flavivirus. In certain embodiments, the dengue virus chimeras can be combined in an immunogenic composition of use as a bivalent, trivalent or tetravalent vaccine against the known dengue virus serotypes can confer immunity to other pathogenic flaviviruses by including nucleic acids encoding one or more proteins from a different flavivirus.

In some embodiments, avirulent, immunogenic dengue virus chimeras provided herein contain the nonstructural protein genes of the attenuated dengue-2 virus (e.g., PDK-53), or the equivalent thereof, and one or more of the structural protein genes or immunogenic portions thereof of the flavivirus against which immunogenicity is to be induced in a subject. For example, some embodiments concern a chimera having attenuated dengue-2 virus PDK-53 genome as the viral backbone, and one or more structural protein genes encoding capsid, premembrane/membrane, or envelope of the PDK-53 genome, or combinations thereof, replaced with one or more corresponding structural protein genes from DEN-1, DEN-3 or DEN-4 or other flavivirus to be protected against, such as a different flavivirus or a different dengue virus serotype. In accordance with these embodiments, a nucleic acid chimera disclosed herein can have functional properties of the attenuated dengue-2 virus and is avirulent, but expresses antigenic epitopes of the structural gene products of DEN-1, DEN-3 or DEN-4 in addition to other flaviviruses and is immunogenic (e.g., induces an immune response to the gene products in a subject). Then, these constructs are passaged 1 or more times beyond the 53 passages to produce a live, attenuated virus composition of use to generate an immunogenic composition against one or more dengue virus serotypes (e.g., P1-P10).

In another embodiment, a nucleic acid chimera can be a nucleic acid chimera having, but not limited to, a first nucleotide sequence encoding nonstructural proteins from an attenuated dengue-2 virus, and a second nucleotide sequence encoding a structural protein from dengue-4 virus alone or in combination with another flavivirus. In other embodiments, the attenuated dengue-2 virus can be vaccine strain PDK-53 having one or more reverted amino acids to the wild-type amino acid (see Examples) selected for improved physical properties or increased immunogenicity. These specific reversions confer desirable traits of use as live, attenuated dengue-2 or as chimeric constructs described herein in regimens against dengue virus infection in children and young adults. Some embodiments include structural proteins of one or more of C, prM or E protein of a second dengue virus.

In other embodiments disclosed herein, nucleotide and amino acid sequences can include substitutions, deletions or insertions for example, in the PDK-53 dengue-2 genome to reduce interference with other targeted dengue virus serotypes. These modifications can be made in structural and nonstructural proteins alone or in combination with the example modifications disclosed herein and can be generated by passaging the attenuated virus and obtaining an improved composition for inducing an immune response against one or more dengue virus serotypes.

Certain embodiments disclosed herein provide for method for making chimeric flaviviruses using recombinant techniques, for example, by inserting substitute sequences of one serotype into another serotype backbone. Other embodiments herein concern passaging a confirmed (e.g., safe and effective) live, attenuated chimeric virus for additional improvements and selecting desirable traits. In certain embodiments, a live, attenuated dengue-2 used herein can include one or more mutations represented in Table 3. In other embodiments, a dengue-dengue chimera of the instant application can include one or more mutations as presented in Table 3. In yet other embodiments, a dengue-dengue chimera can include all of the mutations for each chimera as represented in Table 3 for Den-2/Den-1, Den-2/Den-3 or Den-2/Den-4. Pharmaceutical compositions that include a live, attenuated viruses represented by the constructs of Table 3 are contemplated. For example, mono-, di-, tri- or tetravalent compositions are contemplated of use herein using dengue-dengue chimeras and live, attenuated dengue-2 viruses as presented in Table 3.

In certain embodiments, a live, attenuated DEN-2 variant contemplated herein can be formulated into a pharmaceutical composition wherein the pharmaceutical composition can be administered alone or in combination with dengue-dengue chimeras or dengue-flavivirus chimeras. In certain embodiments, a bi-, tri or tetravalent compositions can be administered in a single application or in multiple applications to a subject.

Flavivirus Chimeras

Dengue virus types 1-4 (DEN-1 to DEN-4) are mosquito-borne flavivirus pathogens. The flavivirus genome contains a 5'-noncoding region (5'-NC), a capsid protein (C) encoding region, a premembrane/membrane protein (prM) encoding region, an envelope protein (E) encoding region, a region encoding the nonstructural proteins (NS1-NS2A-NS2B-NS3-NS4A-NS4B-NS5) and a 3' noncoding region (3'NC). The flaviviral structural proteins include C, prM and E. The nonstructural proteins include NS1-NS5. The structural and nonstructural proteins are translated as a single polyprotein and processed by cellular and viral proteases.

Flavivirus chimeras can be constructs formed by fusing non-structural protein genes from one type, or serotype, of dengue virus or virus species of the flaviviridae, with protein genes, for example, structural protein genes, from a different type, or serotype, of dengue virus or other flavivirus. In other embodiments, a flavivirus chimera construct can be formed by fusing non-structural protein genes from one type, or serotype, of dengue virus or virus species of the flaviviridae, with further nucleotide sequences that direct the synthesis of polypeptides or proteins selected from other dengue virus serotypes or other flaviviruses. In other embodiments, substitution of sequences is contemplated of one flavivirus to another.

In other embodiments, dengue chimeras can contain the nonstructural protein genes of a live, attenuated dengue virus, or the equivalent thereof, and one or more of the structural protein genes, or antigenic portions thereof, of the dengue virus or other flavivirus against which immunogenicity is to be conferred.

Other suitable dengue viruses for use in constructing dengue chimeras can be wild-type, virulent DEN-1 16007, DEN-2 16681, DEN-3 16562 and DEN-4 1036 and attenuated, vaccine-strain DEN-1 PDK-13, DEN-2 PDK-53, DEN-3 PMK-30/FRhL-3 and DEN-4 PDK-48. Genetic differences between the DEN-1, DEN-2, DEN-3 and DEN-4 wild type/attenuated virus pairs are contemplated along with changes in the amino acid sequences encoded by the viral genomes.

In some embodiments, the dengue-2 virus of use herein can include a DEN-2 PDK-53-V variant, where genome nucleotide position 5270 is mutated from an A to a T and amino acid position 1725 of the polyprotein or amino acid position 250 of the NS3 protein contains a valine residue of the dengue-2 full length sequence. One DEN-2 PDK-53 variant without this nucleotide mutation, DEN-2 PDK-53-E, differs from PDK-53-V in this position. DEN-2 PDK-53-E has an A at nucleotide position 5270 and a glutamate at polypeptide position 1725, NS3 protein amino acid position 250. In some embodiments, a modified PDK 53 dengue-2 can include one or more reversions of these positions to the native sequence in order to obtain more desirable traits of use in vaccine compositions contemplated herein.

In certain embodiments, dengue-dengue chimeras can include a DEN-2 virus-specific infectious clone having a modified backbone and structural genes (prM-E or C-prM-E) inserted from other dengue viruses or other flaviviruses. In some embodiments, a dengue-2 backbone variant can be generated from a dengue-2 16681 strain (P), PDK-53-E (E), or PDK-53-V (V); the last letter indicates the C-prM-E structural genes from the parental (P) strain or its vaccine derivative (V) or the prM-E structural genes from the parental (P) or its vaccine derivative (V1). For example; DEN-2/1-VP denotes the chimera comprising the attenuated DEN-2 PDK-53V backbone comprising a valine at NS3-250 and the C-prM-E genes from wild-type DEN-1 16007; DEN-2/1-VV denotes the DEN-2 PDK-53V backbone with the vaccine strain of dengue-1, DEN-1 PDK-13; DEN-2/1-VP1 denotes the DEN-2 PDK-53V backbone and the prM-E genes from wild-type DEN-1 16007; DEN-213-VP1 denotes the DEN-2 PDK-53V backbone and the prM-E genes from wild-type DEN-3 16562; DEN-2/4VP1 denotes the DEN-2 PDK-53V backbone and the prM-E genes from wild-type DEN-4 1036. Other chimeras disclosed herein are indicated by similar nomenclature.

In some embodiments, dengue-dengue chimeras disclosed herein can contain attenuated dengue-2 virus PDK-53 genome as a backbone where structural protein genes encoding C, prM and E proteins of the PDK-53 genome, or combinations thereof, can be replaced with a corresponding structural protein genes from dengue-1, dengue-3 or dengue-4 virus and optionally, another flavivirus to be protected against, such as a different flavivirus (e.g Zika or yellow fever or combinations thereof) or a different dengue virus strain. Live, attenuated dengue-2 PDK-53 virus strain has a mixed genotype at nucleotide position 5270. A significant portion (approximately 29%) of the virus population encodes un-mutated NS3-250-Glu that is present in the wild type DEN-2 16681 virus rather than the NS3-250-Val mutation. As both genetic variants are avirulent, this mutation may not be necessary in an avirulent chimera.

In certain embodiments, a single mutation at NS1-53, a double mutation at NS1-53 and at 5'NC-57, a double mutation at NS1-53 and at NS3-250 and a triple mutation at NS1-53, at 5'NC-57 and at NS3-250, result in attenuation of the DEN-2 virus. Therefore, the genome of any dengue-2 virus containing such non-conservative amino acid substitutions or nucleotide substitutions at these loci can be used as a base sequence for deriving the modified PDK-53 viruses disclosed herein. Another mutation in the stem of the stem/loop structure in the 5' noncoding region can provide additional avirulent phenotype stability, if desired. Mutations to this region disrupt potential secondary structures important for viral replication.

Mutations disclosed herein can be achieved by any method known in the art including, but not limited to, selected clones having additional features once passaged in a cell line of interest (e.g., Vero cells). It is understood by those skilled in the art that the virulence screening assays, as described herein and as are well known in the art, can be used to distinguish between virulent and avirulent backbone structures.

Construction of Flavivirus Chimeras

Flavivirus chimeras disclosed herein can be produced by splicing one or more of the structural protein genes of one flavivirus against which immunity is desired into a PDK-53 dengue-2 virus genome backbone, or other methods known in the art, using recombinant engineering to remove the corresponding PDK-53 gene and replace it with a dengue-1, dengue-3 or dengue-4 virus gene or other gene known in the art.

Alternatively, using the sequences provided in the sequence listing, the nucleic acid molecules encoding the flavivirus proteins may be synthesized using known nucleic acid synthesis techniques and inserted into an appropriate vector. Live, attenuated viruses disclosed herein can be produced using recombinant engineering techniques known to those skilled in the art.

Suitable chimeric viruses or nucleic acid chimeras containing nucleotide sequences encoding structural proteins of other flaviviruses or dengue virus serotypes can be evaluated for usefulness as vaccines by screening them for the foregoing phenotypic markers of attenuation that indicate avirulence and by screening them for immunogenicity. Antigenicity and immunogenicity can be evaluated using in vitro or in vivo reactivity with flavivirus antibodies or immunoreactive serum using routine screening procedures known to those skilled in the art.

Dengue Virus Vaccines

In certain embodiments, chimeric viruses and nucleic acid chimeras can provide live, attenuated viruses useful as immunogens or vaccines. Some embodiments include chimeras that exhibit high immunogenicity to dengue-4 virus while producing no dangerous pathogenic or lethal effects.

To reduce occurrence of DHF/DSS in children and young adults vaccinated against only one serotype of dengue virus, a tetravalent vaccine is needed to provide simultaneous immunity for all four serotypes of the virus. A tetravalent vaccine can be produced by combining a live, attenuated dengue-2 virus of the instant application with dengue-2/1, dengue-2/3, and dengue-2/4 chimeras or other dengue virus construct described herein in a suitable pharmaceutical carrier for administration as a multivalent vaccine.

In certain embodiments, chimeric viruses or nucleic acid chimeras of the present disclosure can include structural genes of either wild-type or live, attenuated viruses on an attenuated DEN-2 virus backbone. For example, a dengue-2/dengue-4 chimera can express the structural protein genes of wild-type DEN-4 1036 virus.

In certain methods, viruses used in the chimeras described herein can be grown using techniques known in the art. Virus plaque titrations can then be performed and plaques counted in order to assess the viability and phenotypic characteristics of the growing cultures. Wild type viruses can be passaged through cultured cell lines to derive attenuated candidate starting materials.

In certain embodiments, chimeric clones can be constructed from various dengue serotype clones available to one of skill in the art. Cloning of virus-specific cDNA fragments can also be accomplished. cDNA fragments containing the structural protein or nonstructural protein genes can be amplified by reverse transcriptase-polymerase chain reaction (RT-PCR) from dengue virus RNA with various primers. Amplified fragments can be cloned into the cleavage sites of other intermediate clones. Intermediate, chimeric dengue virus clones can then be sequenced to verify accuracy of the inserted dengue virus-specific cDNA.

Full genome-length chimeric plasmids constructed by inserting the structural protein and/or nonstructural protein gene region of dengue serotype viruses into vectors are obtainable using recombinant techniques well known to those skilled in the art. Nucleotide and Amino Acid Analysis An NS1-53 mutation in the DEN-2 PDK-53 vaccine virus is significant for the attenuated phenotype of this virus, because the NS1-53-Gly of the DEN-2 16681 virus is conserved in nearly all flaviviruses, including the tick-borne viruses, sequenced to date. DEN-4 vaccine virus can also contain an amino acid mutation in the NS1 protein at position 253. This locus, which is a Gln-to-His mutation in DEN-4 PDK-48 vaccine virus, is Gln in all four wild serotypes of dengue virus. This Gln residue is unique to the dengue viruses within the flavivirus genus. The NS1 protein is a glycoprotein that is secreted from flavivirus-infected cells. It is present on the surface of the infected cell and NS1-specific antibodies are present in the serum of virus-infected individuals. Protection of animals immunized with NS1 protein or passively with NS1-specific antibody has been reported. The NS1 protein appears to participate in early viral RNA replication.

In certain embodiments, mutations that occurred in the NS2A, NS2B, NS4A, and NS4B proteins of the DEN-1, -2, -3 and -4 attenuated strains are conservative in nature. The NS4A-75 and NS4A-95 mutations of DEN-2 and DEN-4 vaccine viruses, respectively, occurred at sites of amino acid conservation among dengue viruses, but not among flaviviruses in general.

Nucleic acid sequences encoding the DEN-4. DEN-3 or DEN-1 virus (e.g., structural elements) can be inserted into a vector, such as a plasmid, and recombinantly expressed in a living organism (e.g., into a dengue-2 backbone) to produce recombinant dengue virus peptides and/or polypeptides and/or viruses.

Nucleic Acid Detection Methods

A rapid genetic test that is diagnostic for each of the vaccine viruses described herein is provided by the present disclosure. This embodiment of the present disclosure enhances analyses of viruses isolated from the serum of vaccinated humans who developed a viremia, as well as enhancing characterization of viremia in nonhuman primates immunized with the candidate vaccine viruses.

These sequences can include a diagnostic TaqMan probe that serves to report the detection of the cDNA amplicon amplified from the viral genomic RNA template by using a reverse-transciptase/polymerase chain reaction (RT/PCR), as well as the forward and reverse amplimers that are designed to amplify the cDNA amplicon, as described below. In certain instances, one of the amplimers has been designed to contain a vaccine virus-specific mutation at the 3'-terminal end of the amplimer, which effectively makes the test even more specific for the vaccine strain because extension of the primer at the target site, and consequently amplification, will occur only if the viral RNA template contains that specific mutation.

Automated PCR-based nucleic acid sequence detection system can be used, or other known technology for nucleic acid detection. The TaqMan assay is a highly specific and sensitive assay that permits automated, real time visualization and quantitation of PCR-generated amplicons from a sample nucleic acid template. TaqMan can determine the presence or absence of a specific sequence. In this assay, a forward and a reverse primer are designed to anneal upstream and downstream of the target mutation site, respectively. A specific detector prof which is designed to have a melting temperature of about 10.degree. C. higher than either of the amplimers and containing the vaccine virus-specific nucleotide mutation or its complement (depending on the strand of RT/PCR amplicon that is being detected), constitutes the third primer component of this assay.

A probe designed to specifically detect a mutated locus in one of the vaccine viral genomes will contain the vaccine-specific nucleotide in the middle of the probe. This probe will result in detectable fluorescence in the TaqMan assay if the viral RNA template is vaccine virus-specific. However, genomic RNA templates from wild-type DEN viruses will have decreased efficiency of probe hybridization because of the single nucleotide mismatch (in the case of the parental viruses DEN viruses) or possibly more than one mismatch (as may occur in other wild-type DEN viruses) and will not result in significant fluorescence. The DNA polymerase is more likely to displace a mismatched probe from the RT/PCR amplicon template than to cleave the mismatched probe to release the reporter dye (TaqMan Allelic Discrimination assay, Applied Biosystems).

One strategy for diagnostic genetic testing makes use of molecular beacons. The molecular beacon strategy also utilizes primers for RT/PCR amplification of amplicons, and detection of a specific sequence within the amplicon by a probe containing reporter and quencher dyes at the probe termini. In this assay, the probe forms a stem-loop structure. The molecular beacons assay employs quencher and reporter dyes that differ from those used in the TaqMan assay.

Pharmaceutical Compositions

Embodiments herein provide for administration of compositions to subjects in a biologically compatible form suitable for pharmaceutical administration in vivo. By "biologically compatible form suitable for administration in vivo" is meant a form of the active agent (e.g., pharmaceutical agent, of the embodiments) to be administered in which any toxic effects are outweighed by the therapeutic effects of the active agent. Administration of a therapeutically active amount of the therapeutic compositions is defined as an amount effective, at dosages and for periods of time necessary to achieve the desired result. For example, a therapeutically active amount of a compound may vary according to factors such as the disease state, age, sex, and weight of the individual, and the ability of antibody to elicit a desired response in the individual. Dosage regima may be adjusted to provide the optimum therapeutic response.

In one embodiment, the compound (e.g., live, attenuated viruses of the embodiments) can be administered in a convenient manner, for example, subcutaneous, intravenous, by oral administration, inhalation, intradermal, transdermal application, intravaginal application, topical application, intranasal or rectal administration. Depending on the route of administration, the active compound can be contained in a protective buffer (e.g., albumin and trehalose, poloxamer 407/trehalose/albumin (FTA)). In one embodiment, a composition can be administered orally. In another embodiment, the composition may be administered intravenously. In one embodiment, the composition may be administered intranasally, such as inhalation. In yet another embodiment, the composition may be administered intradermally using a needle-free system (e.g., Pharmajet®) or other intradermal administration system.

In certain embodiments, a composition can be administered to a child or young adult in an appropriate carrier or diluent. In certain embodiments, live, attenuated dengue virus vaccines can be administered to the child or young adult in a stabilizing formulation (e.g. albumin and trehalose; FTA, or other formulations for stabilizing the live, attenuated virus. "Pharmaceutically acceptable carrier" as used herein can also include diluents such as saline and aqueous buffer solutions. It may be necessary to combine the live, attenuated virus formulations with, or co-administer the compound with, a material to prevent its inactivation. In certain embodiments, one or more formulations of live, attenuated dengue viruses can be administered to the child or young adult subcutaneously or intradermally in an initial dose followed by a booster. Dispersions can also be prepared in glycerol, liquid polyethylene glycols, and mixtures thereof and in oils. Under ordinary conditions of storage and use, these preparations can contain a preservative to prevent the growth of microorganisms or other stabilizing formulation (e.g., FTA or other stabilizing formulations of use to stabilize live, attenuated flaviviruses or chimeras thereof).

Pharmaceutical compositions suitable for injectable use play be administered by means known in the art. For example, sterile aqueous solutions (where water soluble) or dispersions and sterile powders for the extemporaneous preparation of sterile injectable solutions or dispersion may be used. In some embodiments, the composition can be sterile and can be fluid for ease of syringability. A pharmaceutically acceptable carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of microorganisms can be achieved by adding various antibacterial or antifungal agents or other agents.

In some embodiments, upon formulation, solutions can be administered in a manner compatible with the dosage formulation and in an amount as is therapeutically effective. In accordance with these embodiments, formulations can be easily administered in a variety of dosage forms, such as the type of injectable solutions described above. In certain examples, live, attenuated dengue viruses and/or chimeras can be delivered in a formulation having a specific ratio, for example 5:4:5:5, 4:4:5:5, or other ratio (e.g., PFUs of a given dengue virus serotype) where dengue-3 and/or dengue-4 constructs in a trivalent or tetravalent formulation are at least one-half a log greater in terms of pfus than the dengue-1 and/or dengue-2 represented in the formulation. In certain embodiments, dengue-3 and dengue-4 live, attenuated or chimeras are at least one log greater in pfu concentration than that of dengue-1 and/or dengue-2 in a tetravalent formulation. In some embodiments, a DEN2/4 chimera can be present in higher concentrations than other dengue virus serotypes such as a live, attenuated dengue-1 and/or live, attenuated dengue-2.

In certain embodiments, a single dose or multiple doses of a dengue formulation can also be administered to a child or young adult of about 1 year to about 20 years of age. In some embodiments, a child or young adult can be treated with a single dose formulation. In other embodiments, a child or young adult can be treated in at least two doses of a live, attenuated dengue virus formulation. In certain embodiments, a child or young adult can be administered a composition of a dengue-dengue formulation on day 0 and a booster dose within about 3 months of the first dose. In certain embodiments, the children and young adults are naïve subjects (seronegative) never having been exposed to dengue virus. In other embodiments, the children and young adults can be previously exposed to dengue virus and/or a dengue virus infection (seropositive). In accordance with these embodiments, seronegative children and/or seronegative young adults can be treated at day 0 and then receive a booster within 6 months, within, 5 months, within 4 months, within 3 months or less of the first dose in order to produce an increased immune response to dengue viruses. In certain embodiments, the children can be children of about 2 years to about 17 years of age. In other embodiments, the children are 2 years to 17 years of age.

In another embodiment, nasal solutions or sprays, aerosols or inhalants may be used to deliver live, attenuated dengue virus formulations to a subject. Certain formulations can include excipients, for example, pharmaceutical grades of mannitol, lactose, starch, magnesium stearate, sodium saccharine, cellulose, magnesium carbonate and the like.

A pharmaceutical composition can be prepared with carriers that protect active ingredients against rapid elimination from the body, such as time-release formulations or coatings. Such carriers can include controlled release formulations, such as, but not limited to, microencapsulated delivery systems, and biodegradable, biocompatible polymers, such as ethylene vinyl acetate, polyanhydrides, polyglycolic acid, polyorthoesters, polylactic acid and others are known.

In certain embodiments, dose ranges of live, attenuated dengue-dengue chimeras, live, attenuated dengue viruses or flavivirus chimeras can be from about $10^2$ to about $10^6$ PFU administered initially and optionally, followed by at least a second administration within 30 days or up to 12 months later, as needed. In certain embodiments, a subject can receive dual administration of a mono, bi-, tri or tetravalent composition disclosed herein wherein the composition is a single composition mixture or has predetermined compositions of different dengue virus serotypes.

It will be apparent that, for any particular child or young adult or any particular aged child, specific dosage regimens may be adjusted according to the individual need. In some embodiments, a dosage regimen is adjusted to accommodate juvenile subjects, such as children about 20 years of age or younger, or children about 18 years of age or younger or about 15 years of age or younger or about 12 years of age or younger or about 9 years of age or younger or about 6 years of age or younger, or about 3 years of age or younger or about 1.5 years of age or younger. In certain embodiments, a child can be 2 years to 17 years of age. In other embodiments, a child can be 4 to 16 years of age.

In certain embodiments, immunogenic compositions disclosed herein can be administered to a child or young adult, in one or more doses. In some embodiments, immunogenic compositions disclosed herein can be administered to subjects in a single dose, or in two doses or more within a predetermined period of time, including but not limited to, within about 6 months, within about 120 days, within about 90 days, within about 80 days, within about 70 days, within about 60 days, within about 50 days, within about 40 days, within about 30 days, within about 20 days, within about 10 days, within about 5 days, or less or on the same day within hours or minutes or simultaneously administered in the same or different anatomical locations. In some embodiments, immunogenic compositions disclosed herein can be administered within about 90 days of each other, within about 60 days of each other, within about 30 days of each other, and with less than about 30 days of each other. In some embodiments, a composition disclosed herein can be administered to a subject subcutaneously or intradermally. Administration in two or more anatomical sites can include any combination of administration including by the same mode in two or more anatomical sites or by two different modes that include two separate anatomical sites. In accordance with these embodiments, two or more anatomical sites can include different limbs or different areas of the body. In certain embodiments, two doses of the vaccine composition can be consecutively introduced to a subject in the same or multiple anatomical locations to, for example, to protect against all dengue serotypes (e.g., cross protection) at day 0. In certain embodiments, immunogenic composition disclosed herein can include, but are not limited to, a single dose that induces an immunogenic reaction to all four serotypes (e.g., a tetravalent formulation) administered to a subject, which is capable of inducing an immune response to all dengue virus serotypes. In certain embodiments, a subject can receive a single dose composition where the single dose is capable of inducing an adequate immune response to all four dengue virus serotypes. In other embodiments, an immunogenic composition can include live, attenuated dengue virus serotypes in combination with other immunogenic agents against other flaviviruses (e.g., Zika virus, Japanese encephalitis, West Nile, St Louis encephalitis virus, yellow fever or other viruses). In certain embodiment, vaccines against dengue viruses disclosed herein can be used to reduce other related viral infections, for example, Zika virus infection.

In some embodiments, pharmaceutical compositions disclosed herein can be used to increase immune response of a target formulation in a child or young adult by combining an immunogenic composition against dengue virus with an agent to boost $CD8^+$ T cell-response or other immune response against one or more dengue virus serotype (e.g. one or more structural or non-structural components of dengue virus) in a child or young adult receiving such a pharmaceutical composition against dengue virus.

Topical administration is accomplished via a topically applied cream, gel, rinse, etc. containing therapeutically effective amounts of inhibitors of serine proteases. Transdermal administration is accomplished by application of a cream, rinse, gel, etc. capable of allowing the inhibitors of serine proteases to penetrate the skin and enter the blood stream. In addition, osmotic pumps may be used for administration. The necessary dosage will vary with the particular condition being treated, method of administration and rate of clearance of the molecule from the body.

Other embodiments concern methods for decreasing inactivation of live, attenuated viruses including, but not limited to, combining one or more live attenuated viruses with a composition capable of reducing inactivation of a live, attenuated virus (e.g. flavivirus). These compositions can include, but not limited to, one or more protein agents; one or more saccharides or polyols agents; and optionally, one or more EO-PO block copolymer, where the composition can decrease inactivation or stabilize the live attenuated virus.

In certain embodiments, compositions contemplated herein can be partially or wholly dehydrated or hydrated. In other embodiments, stabilizing protein agents contemplated of use in pharmaceutical or non-pharmaceutical compositions herein can include, but are not limited to, lactalbumin, human serum albumin, a recombinant human serum albumin (rHSA), bovine serum albumin (BSA), other serum albumins or albumin gene family members. Saccharides or polyol agents can include, but are not limited to, monosaccharides, disaccharides, sugar alcohols, trehalose, sucrose, maltose, isomaltose, cellibiose, gentiobiose, laminaribose, xylobiose, mannobiose, lactose, fructose, sorbitol, mannitol, lactitol, xylitol, erythritol, raffinose, amylse, cyclodextrins, chitosan, or cellulose. In certain embodiments, surfactant agents can include, but are not limited to, a nonionic surfactant such as alkyl poly(ethylene oxide), copolymers of poly(ethylene oxide) and poly(propylene oxide) (EO-PO block copolymers), poly(vinyl pyrroloidone), alkyl polyglucosides (such as sucrose monostearate, lauryl diglucoside, or sorbitan monolaureate, octyl glucoside and decyl maltoside), fatty alcohols (cetyl alcohol or olelyl alcohol), or cocamides (cocamide MEA, cocamide DEA and cocamide TEA).

In other embodiments, the surfactants can include, but are not limited to, poloxamer 407 (e.g. Pluronic F127®), poloxamer 335, 338 or 238 instead of or in addition to poloxamer 407, or other EO-PO block copolymers with similar characteristics to F127®.

In some embodiments, vaccine compositions can include, but are not limited to, one or more protein agent that is serum albumin; one or more saccharide agent that is trehalose; and one or more surfactant polymer agent such as an EO-PO block copolymer, poloxamer 407 or more specifically, Pluronic F127®.

In other embodiments, formulations for stabilizing live viruses can include one or more live Flaviviruses, one or more carbohydrate agents, and one or more amino acids or salts, esters or amide derivatives thereof. In other embodiments, formulations of use herein stabilize live, attenuated Flaviviruses for commercial use. In some embodiments, the composition further includes a buffer. In accordance with these embodiments, the buffer can include but is not limited to, phosphate buffered saline (PBS). In accordance with these embodiments, the buffer can include at least one of sodium chloride (NaCl), monosodium and/or disodium phosphate ($Na_2HPO_4$), potassium chloride (KCl), and potassium phosphate ($KH_2PO_4$). In some embodiments, the buffer of the composition can include sodium chloride at a concentration of 25 mM to 200 mM. In other embodiments, compositions disclosed herein can include urea and/or MSG other suitable agent.

In some embodiments, live, attenuated flaviviruses such as dengue virus can be stabilized in a formulation that includes but is not limited to, recombinant HSA having a concentration from 0.1% to 0.2% (w/v); and/or sucrose having a concentration from about 4.0% to about 6.0% (w/v); and/or mannitol concentration having a concentration from about 2% to 4% (w/v); and/or alanine having a concentration from about 8.0 mM to about 22.0 mM; and/or methionine having a concentration from about 1.0 mM to about 5.0 mM; and/or MSG having a concentration from about 8.0 mM to 12.0 mM; and/or urea having a concentration from about 0.1% to about 0.3% (w/v). In certain embodiments, the composition can include recombinant HSA, trehalose, mannitol, alanine, methionine, MSG and urea. In other embodiments, the stabilizing composition can include HSA at a concentration from about 0.1% to about 0.2% (w/v); trehalose concentration from about 4% to about 6% (w/v); mannitol concentration from about 2% to about 4% (w/v); wherein the alanine concentration is from 8 mM to 22 mM; wherein the methionine is concentration is from 1 mM to 5 mM; wherein the MSG concentration is from 8 mM to 12 mM; and wherein the urea concentration is from 0.1% to 0.3% (w/v). Certain formulations for stabilizing live attenuated viruses can include, but are not limited to, recombinant HSA, sucrose, alanine and urea. In accordance with these embodiments, HSA concentration can be from about 0.1% to about 0.2% (w/v); sucrose concentration can be from about 4% to about 6% (w/v); alanine concentration can be from about 8.0 mM to about 22 mM; and urea concentration can be from about 0.1% to about 0.3% (w/v). Other stabilizing formulations can include recombinant HSA, sucrose, methionine and urea. Recombinant HSA concentration can be from about 0.1% to 0.2% (w/v); sucrose concentration can be from about 4.0% to about 6.0% (w/v); methionine concentration can be from about 1.0 mM to about 5.0 mM; and urea concentration can be from about 0.1% to about 0.3% (w/v). In other embodiments, a stabilizing formulation can include recombinant HSA, sucrose, arginine and urea where recombinant HSA concentration can be from 0.1% to 0.2% (w/v); sucrose concentration can be from 4% to 6% (w/v); arginine concentration can be from 10 mM to 50 mM; and urea concentration can be from 0.1% to 0.3% (w/v). Other stabilizing formulations can include recombinant HSA, trehalose, arginine and urea where the recombinant HSA concentration is from about 0.1% to 0.2% (w/v); the trehalose concentration is from about 4% to 6% (w/v); the arginine concentration is from about 10 mM to 50 mM; and urea concentration is from about 0.1 to 0.3% (w/v). In other embodiments, stabilizing compositions can include recombinant HSA, trehalose, MSG and urea. In accordance with these embodiments, recombinant EISA concentration can be from about 0.1% to about 0.2% (w/v); trehalose concentration can be, from about 4.0% to about 6.0% (w/v); wherein the MSG concentration is from 8 mM to 12 mM; and wherein the urea concentration is from 0.1% to 0.3% (w/v).

Some embodiments herein concern partially or wholly dehydrated live, attenuated viral compositions for transport or other reasons. In accordance with these embodiments, a composition may be 20% or more; 30% or more; 40% or more; 50% or more; 60% or more; 70% or more; 80% or more; or 90% or more dehydrated. In accordance with these embodiments, viral vaccine compositions can be dehydrated and rehydrate in any known stabilizing composition prior to administering a pharmaceutically acceptable composition to a child or young adult.

In certain embodiments, a subject can be a mammal such as a human or a veterinary and/or a domesticated animal or livestock or wild animal. In certain embodiments, immunogenic compositions of the present disclosure can be effective for immunizing juvenile subjects, such as human children that are 20 years of age or younger. Although the state of the art pertaining to current dengue virus vaccine/immunogenic compositions (e.g. dengue/yellow fever chimeras) used in children report low efficacy and/or immunogenicity for children 9 years of age or younger, immunogenic compositions disclosed herein can produce effective immune responses in children from about 1 year to about 17 years or about 1 year to about 9 years of age, or older. Immunogenic compositions disclosed herein demonstrate superior efficacy and immunogenicity as compared to the state of the art.

In one exemplary method, immunogenic compositions disclosed herein having all four dengue virus serotypes represented (e.g., tetravalent formulation), can be administered to a subject, where the immunogenic compositions can elicit immune responses against all four dengue virus serotypes in the subject. In certain embodiments, immunogenic compositions of the present disclosure can include combinations of polynucleotides and/or polypeptides of the various dengue virus serotype constructs or live, attenuated dengue viruses disclosed herein. In other embodiments, immunogenic compositions can include a polynucleotide having a nucleic acid sequence encoding a modified live, attenuated dengue-2 virus serotype represented by SEQ ID NOs: 9 (Pre-Master), 11 (MVS), 13 (WVS) or 15 (BVS); a dengue-1/dengue-2 chimeric polynucleotide having a nucleic acid sequence encoding nonstructural proteins from a modified live, attenuated dengue-2 virus serotype and structural proteins from a dengue-1 virus serotype, represented by SEQ ID NOs: 1 (Pre-Master), 3 (MVS), 5 (WVS) or 7 (BVS); a dengue-3/dengue-2 chimeric polynucleotide having a nucleic acid sequence encoding nonstructural proteins from a modified live, attenuated dengue-2 virus serotype and structural proteins from a dengue-3 virus serotype, represented by SEQ ID NOs: 17 (Pre-Master), 19 (MVS), 21 (WVS) or 23 (BVS); and a dengue-4/dengue-2 chimeric polynucleotide having a nucleic acid sequence encoding nonstructural proteins from a modified live, attenuated dengue-2 virus serotype and structural proteins from a dengue-4 virus serotype represented, by SEQ ID NOs: 25 (Pre-Master), 27 (MVS), 29 (WVS) or 31 (BVS). These polynucleotides can be included with or without the various polypeptides they encode. In certain embodiments, immunogenic compositions disclosed herein can include one or more polypeptides corresponding to a modified live, attenuated dengue-2 virus serotype represented by SEQ ID NOs: 10 (Pre-Master), 12 (MVS), 14 (WVS) or 16 (BVS); one or more polypeptides corresponding to a dengue-1/dengue-2 chimeric polynucleotide represented by SEQ ID NOs: 2 (Pre-Master), 4 (MVS), 6 (WVS) or 8 (BVS); one or more polypeptides corresponding to a dengue-3/dengue-2 chimeric polynucleotide represented by SEQ ID NOs: 18 (Pre-Master), 20 (MVS), 22 (WVS) or 24 (BVS); and/or one or more polypeptides corresponding to a dengue-4/dengue-2 chimeric polynucleotide represented by SEQ ID NOs: 26 (Pre-Master), 28 (MVS), 30 (WVS) or 32 (BVS).

Concentrations of various polynucleotides and polypeptides disclosed herein (e.g., TDV-1, TDV-2, TDV-3 and TDV-4) can be about the same, or certain dengue virus serotypes can be represented in an immunogenic composition more than others, depending on need or outbreak of one or more serotypes. In accordance with these embodiments, various concentrations or ratios can be expressed as log PFU concentrations compared to one another, as illustrated in FIGS. 11A-11B. Concentrations can be applied to various tetravalent formulations of immunogenic compositions disclosed herein based on ratios of TDV-1 to TDV-2 to TDV-3 to TDV-4, for example. Concentrations can include, but are not limited to log PFU concentrations of, 3:3:3:3, 4:4:4:4, 5:5:5:5, 5:1:5:5, 3:2:3:3, 4:2:4:4, 5:3:5:5, 4:3:4:4, 5:4:5:5, 4:4:5:5, or any concentration ratios of any of dengue virus serotypes, depending on, for example, the number of serotypes represented in the formulation, predetermined response and effect desired, as would be readily recognized by one of skill in the art based on the present disclosure.

In certain embodiments, concentrations of live, attenuated dengue-2 viruses can be 0.5 1, 1.5 2, 2.5 3 or 4 log PFU lower than one or more of other dengue virus serotypes in an immunogenic composition in order to induce a more balanced immune response to all four dengue virus serotypes and reduce viral interference. Although the state of the art pertaining to current dengue virus vaccine/immunogenic compositions report lower efficacy and/or immunogenicity for dengue-2 virus, immunogenic compositions disclosed herein provide formulations that can produce effective immune responses to all four dengue virus serotypes in greater than 60% of subjects and in certain cases about 85% (see, e.g., FIGS. 15-16), including dengue-2, even though live, attenuated dengue-2 virus can be least one log PFU lower than the other dengue virus serotypes. Immunogenic compositions of the present disclosure demonstrate superior efficacy and immunogenicity as compared to the state of the art for subjects 20 years of age or younger and provide a more balance immune response against all four dengue virus serotypes at any age. In certain embodiments, seroconversion rates can be assessed in order to analyze efficacy of a certain formulation over time after administration of the one or more doses of live, attenuate vaccine.

In certain embodiments, immunogenic compositions against dengue virus can include one or more of dengue-1/dengue-2 chimeras having a concentration from about $1.0 \times 10^3$ to about $5 \times 10^5$ PFU; live, attenuated dengue-2 having a concentration from about $1.0 \times 10^3$ to about $5 \times 10^5$ PFU; dengue-3/dengue-2 chimeras having a concentration from about $5.0 \times 10^3$ to about $5 \times 10^5$ PFU; and/or dengue-4/dengue-2 chimeras having a concentration from about $1.0 \times 10^4$ to about $5 \times 10^6$ PFU. In some embodiments, a tetravalent formulation can include a dengue-3/dengue-2 chimera at least one-half to one log greater concentration than dengue-1/dengue-2 chimera and live, attenuated dengue-2 in a tri- or tetravalent formulation while dengue-4/dengue-2 can be at least one-half to one log greater concentration greater than dengue-1/dengue-2 chimera and live, attenuated dengue-2 in a tri- or tetravalent formulation. In certain embodiments, the concentration of dengue-3/dengue-2 and dengue-4/dengue-2 chimeras can be the same or dengue-4/dengue-2 chimera, concentration can be greater than dengue-3/dengue-4 in a bi-, tri- or tetravalent formulation contemplated herein. In some embodiments a subject treated by compositions and methods disclosed herein can be treated 2 times a year, every year, 18 months or similar regimen depending on location of the subject and travel plans for example. In certain embodiments, immunogenic compositions against dengue virus can include one or more of dengue-1/dengue-2 chimeras having a concentration of about $2.0 \times 10^4$ PFU; live, attenuated dengue-2 having a concentration of about $5.0 \times 10^3$ PFU; dengue-3/dengue-2 chimeras having a concentration of about 1×10$^5$ PFU; and/or dengue-4/dengue-2 chimeras having a concentration of about 3.0×10$^5$ PFU.

In certain embodiments, a child or young adult receiving a composition disclosed herein can be assessed over a period of time for development of any symptoms or signs related to dengue infection or other flavivirus infection. For example, a child or young adult can be assessed for onset of dengue fever or other symptom or sign related to dengue infection.

Therapeutic Methods

In one embodiment of the present disclosure, methods provide for inducing an immune response to dengue virus serotype(s) using a mono, bi-, tri or tetravalent formulation of live, attenuated and/or chimeric viral constructs contemplated herein.

Embodiments of the present disclosure is further illustrated by the following non-limiting examples, which are not to be construed in any way as imposing limitations upon the scope thereof. On the contrary, it is to be clearly understood that resort may be had to various other embodiments, modifications, and equivalents thereof which, after reading the description herein, may suggest themselves to those skilled in the art without departing from the spirit of the present disclosure or the scope of the appended claims.

EXAMPLES

The following examples are included to demonstrate certain embodiments presented herein. It should be appreciated by those of skill in the art that the techniques disclosed in the Examples which follow represent techniques discovered to function well in the practices disclosed herein, and thus can be considered to constitute preferred modes for its practice. However, those of skill in the art should, in light of the present disclosure, appreciate that many changes can be made in particular embodiments which are disclosed and still obtain a like or similar result without departing from the spirit and scope herein.

Example 1

In some exemplary methods, compositions used to generate as referred to herein as "master virus seeds (MVS)" are disclosed. These compositions may be derived from one or more live, attenuated dengue viruses, such as DEN-1, DEN-2, DEN-3, and DEN-4. In certain methods, compositions may be derived from one or more live attenuated Dengue viruses that include but are not limited to, specific constructs disclosed herein referred to as TDV-1, TDV-2, TDV-3, and TDV-4 (e.g. previously designated as DENVax). In other exemplary methods, strategies used to generate and characterize these compositions are provided. In yet other embodiments, tetravalent dengue virus formulations and genetic and phenotypic characterization of these formulations are provided. These constructs can be used to generate an immunogenic composition of use to treat a child or young adult from 1 year to 20 years of age.

Production and Analysis of Pre-Master TDV Viruses

Certain procedures were performed to generate pre-master dengue virus seeds, such as serial amplification and purification of dengue viruses (e.g., TDV). First, TDV viruses were re-derived by transfection of viral RNA transcribed from the full-length recombinant TDV cDNA into production-certified cells (e.g., Vero cells), resulting in P1 (passage 1) virus seed. The four P1 viruses from each of dengue-1 to dengue-4 were then amplified and plaque purified to obtain the candidate pre-master vaccine P7 seeds (see Table 1). Certain tests were performed to analyze passages of dengue viruses. For example, full-length genome sequencing demonstrated that all four of the P2 (passage 2) seed viruses were genetically identical to their homologous progenitor, research-derived, research-grade candidate vaccine virus. The original plaque phenotypes were also retained in the P2 viruses. Six plaque purified viruses (P3 A-F) were isolated for each serotype of dengue virus (e g TDV1-4) from the P2 seeds, and each isolated plaque was directly plaque purified two more times. The third plaque purification (P5) of each virus was amplified twice (P6 A-F and P7 A-F) in Vero cells to produce the potential pre-master P7 TDV seeds (Table 1).

TABLE 1

Example of a cGMP Rederivation of TDV Viruses in WCB-Vero Cells

| Passage | Seed Production/Purification | Characterizations |
|---|---|---|
| P1 | Transfect WCB-Vero with transcribed viral RNAs | Plaque titrate |
| P2 | Amplify P1 virus | Full genome sequence |
| P3 | Pick 6 plaques (A-F)/serotype from P2 plaque assay | Plaque purification |
| P4 | Pick plaques A-F from P3 plaque assay | Plaque purification |
| P5 | Pick plaques A-F from P4 plaque assay | Plaque purification |
| P6 | Amplify P5 A-F plaques | Plaque titrate |
| P7 | Pre-master seeds: Amplify P6 A-F | Full genome sequence, TaqMAMA, Plaque phenotypes |
| P8* | MVS: Amplify selected P7 virus seed | Full genetic and phenotypic characterization |
| P9 | WVS: Amplify P8 Master Seed viruses | Full genome sequence, TaqMAMA |
| P10 | BVS: Amplify P9 Working Seed viruses | Full genome sequence, TaqMAMA |

*One optimal P7 seed (A, B, C, D, E, or F) was selected based on the genetic and plaque analysis to make P8 MVS Some tests were further performed to characterize P7 TDV seeds, such as analysis of genome sequences and plaque phenotypes of the P7 seeds, and comparison with P2 seeds (Table 2). Plaque phenotypes of the P7 viruses were generally similar to those of the P2 seeds. In some exemplary experiments, virus titers were monitored. Virus titers reached over 6.0 log pfu/nil for most of the P7 seeds, except for 5 viruses. Genome sequencing of more than 60 candidate vaccine virus seeds after 10 or more serial passages in Vero cells identified no reversion event at NS1-53 and NS3-250 of the three major attenuation determinants of the DENV-2 PDK-53 genetic vector, suggesting that these 2 loci are quite stable in candidate vaccine virus seeds. A sensitive mismatch amplification assay (TaqMAMA) was developed to accurately measure the reversion rate at the 5'NCR-57 locus by real-time RT-PCR. In some studies, the 5'NCR-57 reversion rates of all 24 of the P7 seeds were measured by the TaqMAMA. Depending on the concentration of the input viral RNA for each virus in the assay, the sensitivity limit of the TaqMAMA ranged between 0.01% and 0.07% reversion, which is much more sensitive than the 10-30% reversion sensitivity limit detectable by consensus genome sequence analysis. The resulting data illustrates that 15 of the 24 P7 viruses had minimal or undetectable reversion (<0.07%), One virus (TDV-3-D) had almost 100% reversion, and 8 viruses (e.g. TDV-1, 1 TDV-2, 2 TDV-3, and 4 TDV-4) had partial reversion ranging from 0.08% to 12.85% (Table 2). Full-length genome sequencing was conducted for 16 of the 24 P7 viruses with low levels of 5'NCR57 reversion as measured by TaqMAMA. All the sequenced viruses maintained the other two TDV attenuation determinants (NS1-53, NS3-250), and all had acquired additional mutations that were not present in the original, engineered recombinant cDNA clones (Table 2). In one exemplary target vaccine composition, TDV-1-A, TDV-2-F, TDV-3-F, and TDV-4-F were selected as target pre-master seed for each serotype because their genotypes and plaque phenotypes most closely resembled those of the originally designed vaccine recombinants. The TDV-1-A, TDV-2-F, and TDV-4-F had two non-synonymous mutations, and the TDV-3-F had one. The evidence suggests these additional mutations observed in these 4 pre-master seeds do not cause safety concerns or immunogenicity alterations for the viruses. These pre-master seeds were further amplified to generate the MVS (master seed, designated as P8, Table 1).

Exemplary methods provided herein used purified in-vitro transcribed viral RNA from cloned cDNA plasmid as the pure source to transfect vaccine-certified Vero cells to generate vaccine virus. Serial plaque purifications and full-genome sequence analyses were incorporated into the manufacturing procedures to ensure manufactured vaccine seeds with optimal purity and genetic stability. Six cloned viruses were prepared as potential pre-master seeds for each serotype of TDV. Through genomic analysis, including TaqMAMA and complete genomic sequencing, as well as characterization of viral plaque phenotypes, pre-master seeds were chosen to advance to master virus seeds production for each serotype (serotypes 1-4). The selected pre-master seeds had undetectable reversions (<0.01% or <0.07%) at the 5'NCR-57 locus, with 1 or 2 amino acid substitutions in their genomes, and retained the small plaque phenotypes previously observed.

TABLE 2

Characterizations of pre-master (P7) seeds

| Virus | Clone[a] | TaqMAMA[b] | Log$_{10}$ pfu/ml | Plaque[c] | Mutations identified in genome[d] |
|---|---|---|---|---|---|
| TDV-1 | A | ** | 6.85 | P2 | NS2A-116 I-L, NS2B-92 E-D, one silent |
|  | B | * | 6.93 | P2 | nd[e] |
|  | C | * | 6.93 | D | nd |
|  | D | ** | 7.02 | D | C-67 K-A; one silent |
|  | E | 0.57% | 7.28 | P2 | nd |
|  | F | ** | 7.18 | P2 | E473 T-M; one silent |
| TDV-2 | A | 0.03% | 6.33 | P2 | NS1-314 K-N |
|  | B | * | 6.33 | P2 | E-305 K-T, two silent |
|  | C | * | 5.84 | L | NS4A-18 T-A, four silent |
|  | D | 0.08% | 6.20 | P2 | NS2B-99 I-L, one 3'NCR |
|  | E | 0.03% | 6.31 | P2 | prM-52 K-E, NS5-412 I-V, two silent |
|  | F | ** | 6.15 | P2 | prM-52 K-E, NS5-412 I-V |
| TDV-3 | A | * | 6.00 | P2 | NS5-200 K-N, one silent, one 3'NCR |
|  | B | 0.05% | 6.27 | P2 | NS2A-33 I-T, NS2A-59 M-T |
|  | C | 0.30% | 6.25 | P2 | nd |
|  | D | 100.00% | 6.27 | P2 | nd |
|  | E | 0.31% | 6.00 | P2 | nd |
|  | F | ** | 6.30 | P2 | E-223 T-S, one silent |

TABLE 2-continued

Characterizations of pre-master (P7) seeds

| Virus | Clone[a] | TaqMAMA[b] | Log$_{10}$ pfu/ml | Plaque[c] | Mutations identified in genome[d] |
|---|---|---|---|---|---|
| TDV-4 | A | 0.47% | 5.60 | P2 | E323 K-R/K, NS2B-21 L-F/L, NS2B-39 T-S, one silent |
|  | B | * | 5.65 | D | NS2A-126 A-V; NS4A-5 N-D; NS5-383 K-R, one silent |
|  | C | 4.50% | 5.90 | P2 | nd |
|  | D | 12.85% | 5.97 | D | nd |
|  | E | 0.52% | 6.85 | S | prM-85 E-D, NS2B-45 T-A, NS5-320 M-T, NS5-551 E-G, two silent |
|  | F | 0.02% | 6.93 | S | NS2A-66 D-G, NS4A-21 A-V, four silent |

[a]Cloned viruses (by serial plaque purifications) selected for further development of MVS are designated bold.
[b]*: Reversion rate <0.07% (detection limit). **: Reversion rate <0.01% (detection limit)
[c]Plaque phenotypes: P2: similar to P2 virus; L = larger than P2 virus, D = similar size, but appear somewhat different in clearness of the plaques; S = smaller than P2.
[d]Substitutions differing from the engineered TDV cDNA clones. Amino acid mutations are listed with residue position of the virus protein and the changes (wt-mutation). Total number of silent mutations in structural and non-structural genes of each seed is listed. Mutations at non-coding region (NCR) are also noted.
[e]nd = Not done. These clones had higher 5'NCR-57 reversion rates (by TaqMAMA) than other clones, so were excluded from further sequence analysis.

Example 2

In another exemplary method, compositions of master virus seeds, working virus seeds and bulk virus seeds as well as their genetic and phenotypic characterization are described. These compositions are provided for manufacture of clinical materials and ultimately commercial vaccine supplies. Serial plaque purifications and full-genome sequence analyses were incorporated into the manufacturing process to ensure compositions of vaccine seeds with optimal safety and genetic stability for manufacture of clinical trial materials.

Production and Manufacturing Quality Controls for MVS, WVS, and BVS

In some studies, MVS of the 4 TDV were produced by amplifying the pre-master P7 seed in certified Vero cells. In other studies, MVS were used to make large amount of WVS in cell factories. Further, the BVS stocks of TDV were amplified from the WVS and were used for human clinic trials. Quality controls for product release were performed in some exemplary methods, including testing all of the MVS, WVS, and BVS for identity, infectious titer, sterility, mycoplasma, and in vitro and in vivo adventitious agents. All seeds passed the virus identity test using serotype-specific RT-PCR assays, which showed positive amplification corresponding to its serotype and negative for heterologous serotypes (data not shown). No detectable mycoplasma or adventitious agents were detected in the MVS, WVS, or BVS stocks.

In one exemplary method, immunogenic compositions disclosed herein having all four dengue virus serotypes represented (e.g., tetravalent), can be administered to a child or young adult, where the immunogenic compositions can elicit immune responses against all four dengue virus serotypes in the child or young adult.

Genetic Analysis of the MVS, WVS, and BVS

In certain exemplary methods, after generation of MVS from the selected pre-MVS (P7) strains selected above were produced and the respective viral RNA was sequenced again. Full-length genome sequencing revealed that the MVS for TDV-1 was identical to its pre-master seed, while the WVS and subsequent BVS acquired 2 additional substitutions at E-483 and NS4B-108 (see Tables 2 and 3). The Ala substitution at E-483 represented part of the genotype in the MVS, but became the dominant genotype in BVS. TDV-2 and TDV-3 were identical to their respective pre-master seeds (Table 2 and 3). The TDV-2 MVS was identical to its pre-master seed, and the WVS and BVS had 2 additional mutations at NS4A-36 and NS4B-111. Both mutations were partial in WVS and were the major genotype in the BVS. The MVS of TDV-3 was again identical to the pre-master seed, but the WVS and BVS contained an additional amino acid substitution at NS4A-23. The TDV-4 MVS acquired an additional amino acid mutation, at locus NS2A-99 (from Lys to Lys/Arg mixed genotype) during production of the MVS (Table 3). Its WVS and BVS retained the NS2A-99 Lys/Arg mixed genotype, and the BVS had an extra NS4B-238 Ser/Phe mixed genotype. Consensus sequence results also confirmed that MVS, WVS as well as BV retained the three genetic determinants of attenuation at the 5'NCR-57, NS1-53, and NS3-250 loci. Analysis of the least stable attenuating locus by TaqMAMA demonstrated that the 5'NCR-57 reversion rate between <0.7% to and 0.13% among MVS, ≤0.07% among WVS, and between <0.07 and 0.21% among BVS. A 3% reversion at the 5'NCR-57 locus was considered the maximum permissible rate for acceptance of a vaccine lot (Table 3).

mutations occurred in a given seed. From P1 to MVS (P8) seeds, 2 to 7 nucleotide substitutions were identified in any given TDV seed and only 2 to 3 of these substitutions resulted in amino acid changes. None of the silent mutations in the MVS were within the 5' or 3'NCR that may affect virus replication. Only the change in prM-52 Lys-Glu of the TDV-2, and the substitution in NS2A-66 Asp-Gly of TDV-4 are not conservative changes. The NS2A-66 mutation of the TDV-4 is in the nonstructural backbone part of the DENV-2 PDK-53. Although NS2A-66 locus is usually Asp among various strains of DENV-2, it is usually Gly for DENV-4. It is possible that the Asp to Gly change in the TDV-4 is relevant for fitness of the TDV-4 in Vero cells. The TDV-2 prM-52 mutation resides in the C-terminal portion of the prM that is cleaved out from the mature virus particles. In some exemplary methods, phenotypic characterization was performed to confirm that none of the mutations in the MVS seeds significantly altered the attenuation phenotypes of the vaccine.

The TDV viruses demonstrated high genetic stability during the manufacturing process. The three defined DENV-2 PDK-53 attenuation loci located in 5'NCR, NS1-53, and NS3-250 remained stable in the consensus genome sequence upon serial passage of the TDV from pre-Master strains to bulk vaccine preparations. The highly sensitive TaqMAMA of the 5'NCR-57 locus demonstrated minimal or undetectable reversion in the MVS, WVS (P9/Working), and BVS (Bulk Virus Seed for vaccines) of dengue virus serotypes. The 5'NCR-57 reversion rates of the TDV BVS preparations (P10-equivalent) were significantly lower than the 5'NCR-57 reversion rates that evolved in research-grade

TABLE 3

Nucleotide and amino acid substitutions in TDV seeds

| TDV | Nucleotides | Amino Acids | Pre-master | MVS[a] | WVS[a] | BVS[a] |
|---|---|---|---|---|---|---|
| TDV-1 | 2384 G-C | E-483 Gly-Ala | – | – | Gly/Ala | Ala |
|  | 3823 A-C | NS2A-116 Ile-Leu | Leu | Leu | Leu | Leu |
|  | 4407 A-T | NS2B-92 Glu-Asp | Asp | Asp | Asp | Asp |
|  | 7148 C-T | NS4B-108 Thr-Ile | – | – | Ile | Ile |
|  | 7311 A-G | silent | G | G | G | G |
|  | TaqMAMA | 5'NCR-57 reversion %[b] | -- | – | – | – |
| TDV-2 | 592 A-G | prM-52 Lys-Glu | Glu | Glu | Glu | Glu |
|  | 6481 G-C | NS4A-36 Ala-Pro | – | – | Ala/Pro | Pro |
|  | 7156 C-T | NS4B-111 Leu-Phe | – | – | Leu/Phe | Phe |
|  | 8803 A-G | NS5-412 Ile-Val | Val | Val | Val | Val |
|  | TaqMAMA | 5'NCR-57 reversion %[b] | -- | – | 0.07% | 0.21% |
| TDV-3 | 1603 A-T | E-223 Thr-Ser | Ser | Ser | Ser | Ser |
|  | 6436 G-A | NS4A-23 Asp-Asn | – | – | Asn | Asn |
|  | 7620 A-G | silent | G | G | G | G |
|  | TaqMAMA | 5'NCR-57 reversion %[b] | -- | – | – | – |
| TDV-4 | 225 A-T | silent | T | T | T | T |
|  | 3674 A-G | NS2A-66 Asp-Gly | Gly | Gly | Gly | Gly |
|  | 3773 A-A/G | NS2A-99 Lys-Lys/Arg | – | Lys/Arg | Lys/Arg | Lys/Arg |
|  | 5391 C-T | silent | T | T | T | T |
|  | 6437 C-T | NS4A-21 Ala-Val | Val | Val | Val | Val |
|  | 7026 T-C | silent | T/C | T/C | T/C | T/C |
|  | 7538 C-C/T | NS4B-238 Ser-Ser/Phe | – | – | Ser/Phe | Ser/Phe |
|  | 9750 A-C | silent | C | C | C | C |
|  | TaqMAMA | 5'NCR-57 reversion %[b] | – | 0.13% | – | – |

[a]Bold: Changes started at MVS stocks.
[b]"--" indicates reversion rate <0.01% (detection limit),
"–" indicates reversion rate <0.07% (detection limit)

Full-genome sequence analysis revealed that an additional amino acid mutation developed in the TDV-4 MVS, while the other three TDV MVS lots retained the consensus genome sequence of their pre-master seeds. From P1 seeds to the pre-master (P7) seeds, only 1 or 2 non-synonymous vaccine candidates after 10-serial passages in Vero cells (4-74% reversion). The strategy for large-scale manufacturing of the TDV seeds provided herein resulted in a genetically stable vaccine seed which retained the attenuation markers in the candidate vaccine viruses.

All TDV virus constructs can be stored in stabilizing buffers, for example, FTA, poloxamer 407 F127® 0.01% to about 3.0% w/v) and about 5% to about 50% (w/v) trehalose, 2 and about 0.01% to about 3.0% albumin (e.g. rHSA)

Safety and In Vivo Immunogenicity

In this example, it is demonstrated that exemplary compositions are safe after subcutaneous injection and are essentially immunologically inert. Four different exemplary compositions were selected for testing in mice as follows (data not shown).

Figure 2:
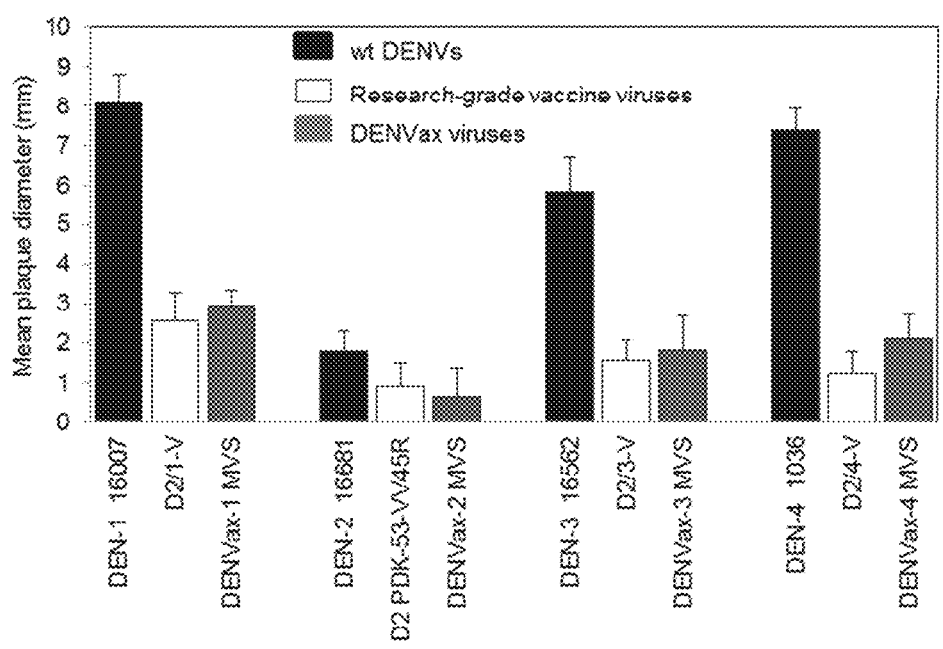

Formulation 1: 15% Trehalose, 2% F-127, 1% rHSA
Formulation 2: 15% Trehalose, 2% F-127, 1% rHSA, 1 mM $CaCl_2$/0.5 mM $MgSO_4$
Formulation 3: 15% Trehalose, 2% F-127, 1% rHSA, 0.5% chitosan
Formulation 4: 22.5% Trehalose, 3% F-127, 1.5% rHSA
Formulation 5: PBS Plaque Phenotype of TDV MVS In one exemplary method, plaque phenotypes of the TDV MVS were compared with wild type Dengue viruses and their homologous research-grade chimeric viruses in Vero cells (FIG. 2). All of the MVS of TDV-1, -2, and -3 produced plaques that were significantly smaller than their wild type homologs and very similar (within 0.4-mm differences) to their homologous research-grade viruses in Vero cells. TDV-4 MVS was also significantly smaller than the wild type DENV-4, but was slightly larger (0.9 mm difference) than the original lab derived D2/4-V chimera.

FIG. 2 represents an exemplary histogram illustrating plaque sizes of the TDV MVS in contrast with control wild type viruses and research-grade vaccine candidate viruses. Mean plaque diameters (mm)±SD (error bars) of the virus plaques in Vero cells under agarose overlay measured on day 9 pi. The wild type DEN viruses, represented by black bars, and previously published research-grade vaccine candidate viruses, represented by white bars, were included for control and comparison to the TDV master vaccine seeds represented by grey bars.

Temperature Sensitivity of TDV MVS

In another exemplary method, temperature sensitivity was tested in Vero cells for the TDV MVS and compared with their homologous wild type and the original research-grade chimeric vaccine virus. The wild type (WT) DENV-3 16562 was not temperature sensitive. The wt dengue virus serotype 1 and dengue virus serotype-4 were moderately temperature sensitive at 39° C. (titers were approximately 1.0 $\log_{10}$ pfu/ml lower at 39° C. than at 37° C., FIG. 3). WT Dengue virus serotype-2 16681 was the most temperature sensitive of the WT Dengue viruses tested, and resulted in a 100-fold titer drop at 39° C. TDV-1, -2, and -3 were as temperature sensitive as their original homologous research-grade chimeric vaccine viruses (FIG. 2). Titers at 39° C. dropped between 2.0 and 3.0 $\log_{10}$ pfu/ml for these TDV strains. TDV-4 was also temperature sensitive, demonstrating a 5-fold reduction in titer. However, the original research-grade D2/4-V demonstrated about a 10-fold reduction in titer. The final stabilized TDV-4 MVS contained poloxamer 407, F127® (and other agents to stabilize these formulations (FTA or bivalent formulations, albumin and trehalose)), which was previously demonstrated to enhance thermal stability of dengue viruses. The presence of F127® in TDV-4 MVS likely contributed to the less pronounced temperature sensitivity of the virus in the Vero culture assay. In a separate experiment, temperature sensitivity of an MVS-derived TDV-4 strain in the absence of F127® was further evaluated. To remove poloxamer 407, F127® from the strain, viral RNA was isolated from a TDV-4 bulk virus preparation and was transfected into Vero cells. This TDV-4 virus appeared to be as temperature sensitive as the D2/4 V research strain (titer reduced 1.5 $\log_{10}$ pfu/ml) on day 3 post infection in the absence of poloxamer 407, F127® (FIG. 3).

Figure 3:
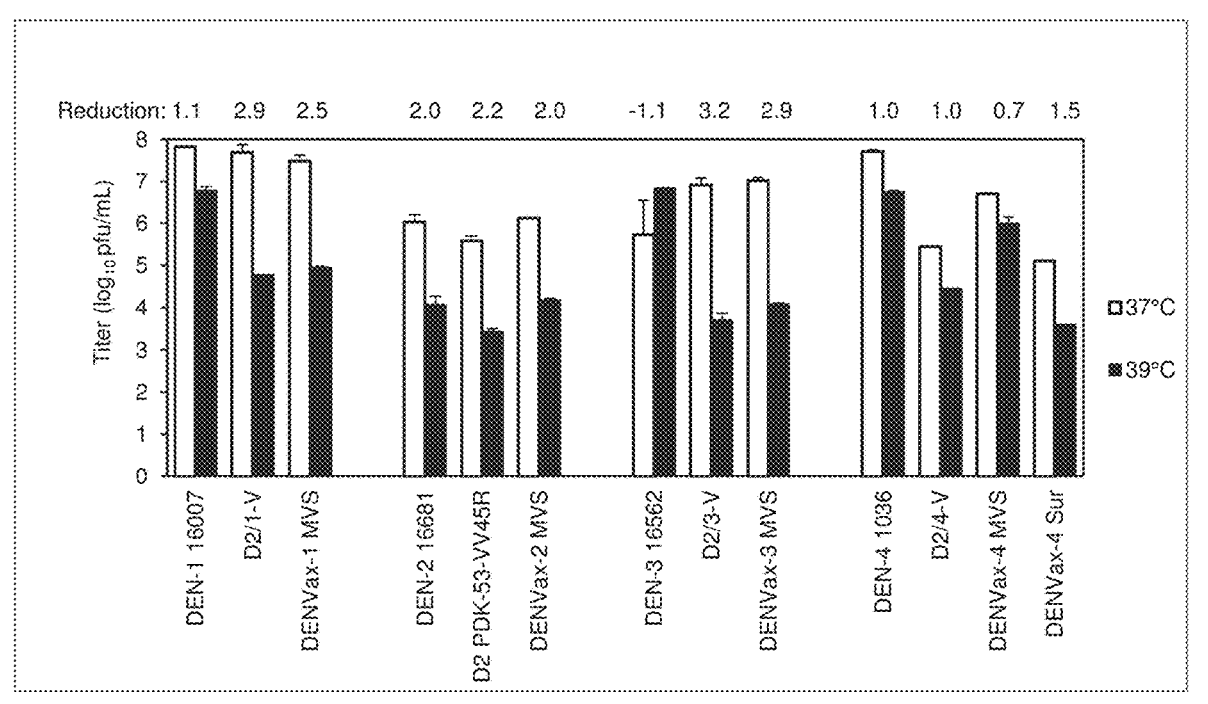

FIG. 3 illustrates an exemplary histogram illustrating temperature sensitivities of TDV MVS. The wild type Dengue viruses and previously published research-grade vaccine candidate viruses were included for comparison. The TDV-4 MVS contains additional poloxamer 407, F127® that can mask the temperature sensitivity results of the virus in this assay. A separate experiment analyzing a surrogate TDV-4 in the absence of F127® was also included. Mean titers±SD (error bars) of the viruses replicated in Vero cells at 37° C. or 39° C.

TDV MVS Replication in Mosquito C6/36 Cells

Figure 4:
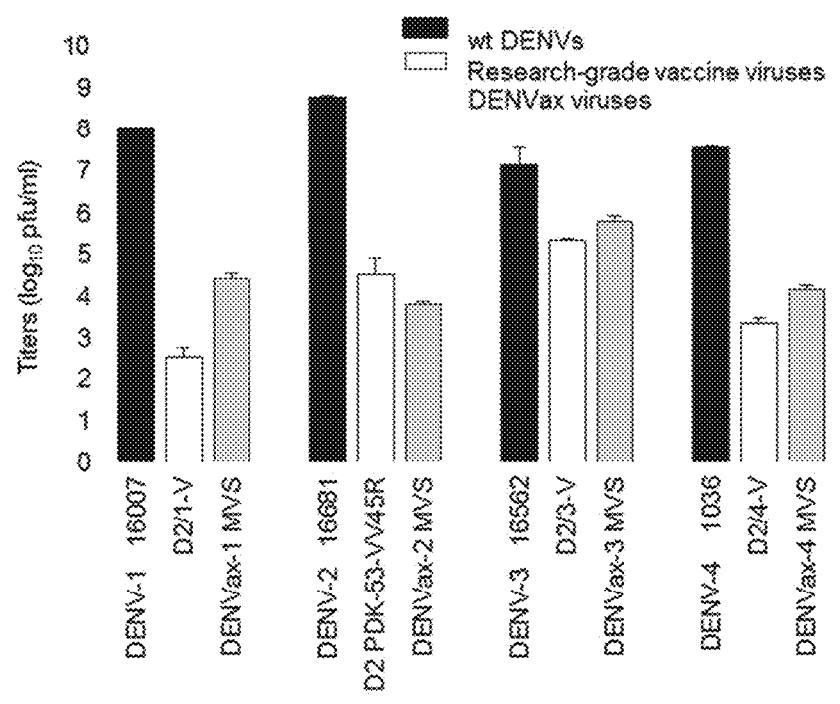

In some exemplary methods, the TDV MVS were grown in C6/36 cells to verify their retention of the in vitro attenuation phenotype, with the knowledge that the research-grade chimeric vaccine viruses retained the attenuation phenotype of the backbone DENV-2 PDK53 virus in these mosquito cells. Compared to the wt Dengue viruses, TDV-1, TDV-2 and TDV-4 MVS showed significant growth reduction (at least 3 $\log_{10}$ pfu/ml reduction) in C6/36 cells on day 6 post infection (pi) (FIG. 4). The TDV-3 MSV also exhibited reduced growth compared to the wt DENV-3 16562, but the reduction was not as marked (1-2 $\log_{10}$ pfu/ml reduction). However, the C6/36 titers of the TDV-3 seed lots were similar (within 1 $\log_{10}$ pfu/ml difference) to the C6/36 titer of the original research-grade chimeric D2/3-V vaccine virus, FIG. 4 illustrates an exemplary histogram plotting restricted growth of TDV MVS (grey bars) in C6/36 cells in comparison with wt Dengue viruses (black bars) and research-grade vaccine viruses (white bars). Mean titers±SD (error bars) of the viruses replicated in C6/36 cells 6 days pi.

Virus Infection, Dissemination, and Transmission Rates in Whole Mosquitoes

In some exemplary methods, the infection and dissemination rates of the TDV were compared with their parental wt Dengue viruses. In certain exemplary experiments, oral infection experiments were conducted in *Ae. aegypti* mosquitoes. Infectious blood meals were back-titrated to measure the virus titers and only the experiments with similar virus titers in the blood meal (less than 1 $\log_{10}$ pfu/ml differences) between parental Dengue viruses and TDV for each serotype were included for comparisons in Table 4. TDV-1, TDV-2, and research-grade D2 PDK-53-VV45R did not infect mosquitoes through oral feeding, which is significantly different (p<0.0001) from their parental viruses, DENV-1 16007 (44% infection) and DENV-2 16681 (43.3% infection). Because no mosquito was infected by TDV-1 and -2, there was little to no dissemination concern for these two vaccine viruses. While TDV-4 did infect some mosquitoes through oral feeding (2 out of 55), the infection rate was significantly lower (p<0.05) than its parental wild type virus, DENV-4 1036 (8 out of 50). TDV-3 did not infect any mosquitoes in two experiments with blood meal viral titers of 5.2±0.02 $\log_{10}$ pfu/ml (Table 4), and in a separate experiment with blood meal viral titer of 6.0 $\log_{10}$ pfu/ml, only 1 out of 30 mosquitoes became infected (data not shown). However, wild type Dengue virus-3 16562 also had a very low infection rate (8%) at 5.2 $\log_{10}$ pfu/ml, and the rate did not increase in a separate experiment with a higher blood meal viral titer at 6.2 $\log_{10}$ pfu/ml (3%, 1 positive out of 30 mosquitoes, data not shown). Although the wild type (WT) Dengue virus-3 and Dengue virus-4 had significantly lower infection rates than the wild type Dengue virus-1 and Dengue virus-2, the mean virus titers in the infected, mosquitoes were similar (3.1 to 3.9 $\log_{10}$ pfu/mosquito). In contrast, the TDV-4 titers from the two infected mosquitoes were both minimal (0.7 $\log_{10}$ pfu/mosquito), which was 1,000-fold lower than the titer from the mosquitoes infected by wild type dengue virus serotype-4 1036 (3.9±1.5 pfu/mosquito).

For those mosquitoes that were infected, dissemination out of the midgut could assessed by determining whether virus was present in the legs. The four parental DENVs resulted in dissemination rates ranging between 36.3% and 62.5%, and their mean virus titers (in $\log_{10}$ pfu) from the legs were between 0.9±0.3 and 2.2±0.7 (excluding negative samples). Neither of the two TDV-4 infected mosquitoes resulted in virus dissemination to the legs (Table 4). While disseminated virus was detectable in the legs, none of the four wt Dengue viruses was detectable in saliva of orally infected mosquitoes, suggesting that oral feeding conditions may not be sufficiently sensitive to measure the transmission rate of these DENVs. Therefore, in other exemplary methods, highly stringent artificial mosquito infections by direct IT inoculation were subsequently performed (Table 4). Except for TDV-4, all viruses (wt and TDV) achieved 100% infection of the IT inoculated *Ae. aegypti*. The TDV-4 inoculum had a slightly lower viral titer than the other three viral inocula, but it still successfully infected 70% of the inoculated mosquitoes. Despite the high body infection rates achieved by IT inoculation, all four TDV viruses exhibited significantly lower ($p<0.005$) or non-detectable transmission rates (0-10%) compared to the wt Dengue viruses (43-87%, Table 4). The TDV viruses demonstrated little to no infection and dissemination after oral feeding, and the highly stringent IT results affirmed the minimal transmission capacity of these TDV viruses in *Ae. aegypti*.

Vector competence is an important safety component for live-attenuated flavivirus vaccine viruses. Previously, the research-grade DENV-2 PDK-53-VV45R virus and wt reversion mutant derivatives were tested in *Ae. aegypti*, and found that the NS1-53-Asp attenuating mutation was the dominant determinant for impaired mosquito replication. The other two major attenuation loci of the DENV-2 PDK-53 vaccine, nucleotide 5'NCR-57-T and NS3-250-Val, also exhibited some inhibiting effect on replication in mosquitoes, thus providing additional, redundant restrictions for mosquito vector competence. Some exemplary methods described herein were used to test the mosquito oral and IT infection and replication for all four TDV strains. TDV-1, -2, and -3 did not infect any *Ae. aegypti* mosquitoes through oral infection (Table 4). The TDV-4 infected only 3.6% of orally exposed mosquitoes, a level significantly lower than that of the wt DENV-4 with a replicative mean titer in the mosquito bodies lower than that of wt DENV-4 infected mosquitoes. Surprisingly, TDV-4 was detected in the legs of the infected mosquitoes, suggesting that TDV-4 was not able to disseminate from the mosquito midgut following oral infection. The infection rates for the TDV-1, -2, and -4 were all significantly less than their wild type counterparts, but the difference was not significant between TDV-3 and WT DENV-3 16562 due to the very low infection rates for both viruses. Compared to other wild type strains of DENV assessed in *Ae. aegypti* collected from the same Mae Sot Province, Thailand, the parental wild type Dengue virus strains used for engineering TDV appeared to have lower infectious and dissemination rates by oral infection. The wt DENV-1 PUO359, DENV-2 PUO218, DENV-3 PaH881/88, and DENV-4 1288 used for engineering the Yellow Fever (YF) 17D vaccine-based ChimeriVax-DEN vaccines had infection rates ranging 47-77%. In contrast, the YF 17D

TABLE 4

Virus infection, dissemination, and transmission rates in whole mosquitoes

| | Oral Feed | | | | | IT inoculation | | | | |
|---|---|---|---|---|---|---|---|---|---|---|
| Virus | Blood Meal[a] Mean ± SD | Infection[b] % (P/N) | Body Titer[c] Mean ± SD | $p^d$ | Dissemination[e] % (P/N)[f] | Inoculum pfu/dose | Infection[b] % (P/N) | Body Titer[c] Mean ± SD | Saliva[f] % (P/N) | $p^d$ |
| DENV-1 16007 | 6.6 | 44.0% (11/25) | 3.6 ± 1.5 | | 36.3% (4/11) | 53.9 | 100% (30/30) | 4.7 ± 0.48 | 43% (13/30) | |
| TDV-1 | 6.9 | 0% (0/30) | NA | <0.0001 | NA | 67.8 | 100% (30/30) | 3.4 ± 0.39 | 10% (3/30) | <0.005 |
| DENV-2 16681 | 6.6 | 43.3% (13/30) | 3.1 ± 1.5 | | 38.5% (5/13) | 67.8 | 100% (30/30) | 5.2 ± 0.34 | 87% (26/30) | |
| D2 PDK53-VV45R | 6.4 | 0% (0/30) | NA | <0.0001 | NA | 56.4 | 100% (30/30) | 4.0 ± 0.20 | 0% (0/30) | <0.0001 |
| TDV-2 | 6.4 | 0% (0/30) | NA | <0.0001 | NA | 52.7 | 100% (30/30) | 3.5 ± 0.27 | 7% (2/30) | <0.0001 |
| DENV-3 16562 | 5.2 | 8% (2/25) | 3.8 ± 0.2 | | 50% (1/23) | 34.0 | 100% (30/30) | 4.2 ± 0.50 | 67% (20/30) | |
| TDV-3 | 5.2 ± 0.02 | 0% (0/50) | NA | 0.108 | NA | 37.3 | 100% (30/30) | 3.3 ± 0.36 | 3% (1/30) | <0.0001 |
| DENV-4 1036 | 5.8 ± 0.5 | 16% (8/50) | 3.9 ± 1.5 | | 62.5% (5/8) | 69.4 | 100% (30/30) | 5.2 ± 0.45 | 70% (21/30) | |
| TDV-4 | 5.4 ± 0.4 | 3.6% (2/55) | 0.7 ± 0.0 | 0.033 | 0% (0/2) | 11.8 | 70% (21/30) | 1.1 ± 0.46 | 0% (0/21) | <0.0001 |

[a]Virus liters or Mean ± standard deviation if from more than 1 experiment in blood meal ($\log_{10}$ pfu/ml) by back titration
[b]Rate of virus detected in mosquito bodies. P/N = positive/total mosquitoes
[c]Mean virus titers ± standard deviation ($\log_{10}$ pfu/mosquito) in mosquito body, only positive sample are included for calculation
[d]Statistic analysis of the differences between wt DENV and TDV by Fisher Exact probability
[e]Rate of virus detected in legs of the positively infected mosquitoes
[f]Rate of virus detected in saliva of the positively infected mosquitoes. Used to measure transmission efficiency vaccine cannot infect *Ae. aegypti*. Although the ChimeriVax strains contained the prM-E from these highly infectious wt DENV, the ChimeriVax retain the mosquito attenuation phenotype of their YF 17D replicative backbone. Results provided herein also indicated that the mosquito attenuation of DENV-2 PDK-53 backbone was maintained in the TDV strains. In addition, using the wt Dengue virus strains with lower mosquito-infectivity in constructs included in compositions described herein provides an additional safety feature.

In one exemplary method, oral infection results illustrate that the TDV had minimum mosquito infectivity and dissemination capacity. In addition, the more sensitive and stringent IT infection experiments were performed to further analyze the potential of TDV to be transmitted by *Ae. aegypti*. The IT results demonstrated that all four TDV viruses had non-detectable or minimal mosquito transmission potential compared to their wt counterparts. TDV transmission could only theoretically occur if (1) vector feeds on a vaccinee with a sufficient viremia titer to infect mosquito midgut, (2) the virus is capable of replicating in the midgut epithelium and able to subsequently disseminate out of the midgut, and (3) the disseminated virus can replicate in salivary gland and expectorate sufficient virus in saliva for transmission. The threshold of human viremia required to infect mosquitoes has not been established adequately, but human viremia can be $10^6$-$10^8$ mosquito infectious dose$_{50}$ (MID$_{50}$)/ml after natural wt DENV infection. This MID$_{50}$ was based on direct IT inoculation of mosquitoes with diluted human plasma. Analysis of TDV in nonhuman primates indicated that viremia titers following TDV immunization were very low (less than 2.4 $\log_{10}$ pfu/ml) and lasted for 2-7 days. Given the low viremia levels and the low mosquito infection, dissemination, and transmission capacity of TDV, it is unlikely that these vaccine viruses could be transmitted by mosquitoes in nature or cause viremia.

Therefore, it is proposed that any of the passages of any of the serotypes (P1-P10) could be used in a composition to generate a safe and effective vaccine against one, two, three or all four dengue virus serotypes.

Neurovirulence in Suckling Mice

The original research-grade vaccine viruses were highly attenuated for neurovirulence in newborn ICR mice maintained in-house at DVBD/CDC. All of these mice survived ic (intracerebral) challenge with $10^4$ pfu of each vaccine virus. The wt Dengue virus serotype-2 16681 virus, on the other hand, resulted in 62.5%-100% mortality in these CDC-ICR mice in various experiments. In some experiments, commercial ICR mice obtained from Taconic Labs (Taconic-ICR) were used to study neurovirulence in newborn mice. It was observed that newborn Taconic-ICR mice were significantly more susceptible to Dengue virus serotype-2 infection than the previous CDC-ICR mice. FIG. 5A summarizes the neurovirulence of wt Dengue virus serotype-2 16681 in CDC-ICR colony and Taconic-ICR newborn mice challenged ic with $10^4$ pfu of the virus. The Taconic-ICR mice (100% mortality in 32 mice, average survival time of 8.3±0.5 days) were more susceptible to ic Dengue virus serotype-2 16681 challenge than the previous CDC-ICR mice (91% fatalities in 72 mice, average survival time of 14.6±13 days).

In other exemplary methods, in order to evaluate neurovirulence of the TDV MVS, the Taconic-ICR mice initially were challenged ic (intracerebrally) with a dose of approximately $10^4$ pfu of wt Dengue virus serotype-2 16681, D2 PDK-53 VV45R, D2/3-V, or TDV 1-4 virus in one (n=16) or two (n=31-32) experiments (FIG. 5B). At this dose, D2/3-V research grade virus, as well as TDV-1, and TDV-3 MVS exhibited fully attenuated neurovirulence phenotypes (no illness or mortality). As expected, wt Dengue virus serotype-2 was found to be "fatal", with average mouse survival time (AST) of 8.3±0.8 days. In these Dengue virus serotype-2-sensitive Taconic-ICR mice, the D2 PDK-53-VV45R research grade virus resulted in 81.3% mortality. The TDV-2 MVS and TDV-4 MVS were uniformly fatal in the Taconic-ICR, showing AST values of 9.8±1.7, 10.2±1.4, and 11.3±0.4 days, respectively.

In some exemplary methods, the neurovirulence of wt Dengue virus serotype-2 16681 virus was compared with that of D2 PDK-53 VV45R, TDV-2 MVS and TDV-4 MVS, as well as D2/4-V research grade virus, at a 10-fold lower dose ($10^3$ pfu, FIG. 5C). The wt Dengue virus serotype-2 retained a uniformly fatal neurovirulent phenotype, with AST of 9.0±1.4 days, at this lower challenge dose. The other 4 viruses exhibited intermediate neurovirulence phenotypes, and the degree of neurovirulence was serotype-specific. The D2 PDK-53-VV45R virus and its TDV-2 MVS cognate showed significant attenuation (32.3% survival with AST of 13.1±3.8 days and 31.2% survival with AST of 10.5±3.4 days, respectively). Both the TDV-4 MVS and the research grade D2/4-V virus were highly attenuated for neurovirulence (81.3% survival with AST of 18.8±5.8 days and 100% survival, respectively). The results suggested that MVS of TDV-1 and -3 exhibited complete attenuation of neurovirulence, while TDV-2 and -4 MVS lots retained attenuation phenotypes that closely resembled their homologous research-grade virus vaccine candidates.

FIGS. 5A-5C represent exemplary graphs illustrating neurovirulence in newborn mice tested with various compositions including wt Dengue virus serotype-2 and different attenuated dengue viruses. Pooled results of numerous experiments summarizing the neurovirulence of wt Dengue virus serotype-2 16681 virus in CDC-ICR (n=72) and Taconic-ICR (n=32) newborn mice challenged is with $10^4$ pfu of the virus (A). Neurovirulence of TDV MVS tested in Taconic-ICR mice with a dose of $10^4$ pfu (B) or $10^3$ pfu (C). The numbers of animals tested per group in one experiment (n=16) or two pooled experiments (n=31 or 32) are indicated.

Plaque Phenotype of WVS, and BVS

Certain studies were performed to compare plaque phenotypes of WVS and BVS with MVS, wt Dengue viruses and their homologous lab derived, research-grade chimeras in Vero cells (FIG. 6). Mean plaque sizes were calculated from 10 plaques for each vaccine virus, but from reduced numbers of wt DENV-1, -3, and -4. All of the MVS viruses of TDV-1, -2, and -3 produced plaques that were significantly smaller than their wt homologs and very similar (within 0.4-mm differences) to their homologous research-grade viruses in Vero cells. TDV-4 MVS was also significantly smaller than the wt DENV-4, but was slightly (0.9 mm) larger than the original lab derived D2/4-V chimera. With the exception of the TDV-2, all of the WVS and BVS of the TDV-1, -3, -4 retained significantly smaller plaque sizes than those produced from their wt homologs. The TDV-2 WVS and BVS produced plaques that were similar to the plaques of wt DENV-2 virus in Vero cells, but when tested in LLC-MK$_2$ cells all of the TDV-2 manufactured seeds produced plaques that were somewhat smaller than those of the wt DENV-2 (1.4±0.4) and similar to the lab derived D2 PDK-53-VV45R (1.0±0.3) (FIG. 6).

Evaluation of the phenotypic markers of viral attenuation, including small plaque phenotype, temperature sensitivity, reduced replication in mosquito cells, reduced infection/dissemination/transmission by mosquitoes and reduced neurovirulence in newborn ICR mice, were assessed for the compositions of MVS stocks. Results indicated that all of the TDV retained the expected attenuation phenotypes similar to the original research-grade vaccine viruses. Given the mutations responsible for attenuation are conserved in all MVS, WVS and BV, it can be expected the attenuated phenotypes to be retained in the material manufactured for human clinical testing.

FIG. 6 represents an exemplary histogram illustrating plaque size of the TDV MVS, WVS, and BVS. Mean plaque diameters±SD (error bars) of the virus plaques in Vero or LLC-MK$_2$ cells under agarose overlay measured on day 9 pi. The wild type DENVs and previously published research-grade vaccine candidate viruses were included for control and comparison.

Virus Replication in Mosquito C6/36 Cells

Previous studies demonstrated that the research-grade PDK-53-based chimeric vaccine viruses retained the attenuation phenotype of the backbone DENV-2 PDK53 virus in C6/36 cells. In some exemplary methods, the TDV MSV, WVS, and BVS were grown in C6/36 cells to verify their retention of this in vitro attenuation marker after large scale manufacturing. Compared to the wild type dengue viruses, except for TDV-3, the manufactured seeds showed marked growth reduction (at least 3 $\log_{10}$ PFU/ml reduction) in C6/36 cells on day 6 pi (FIG. 7). The TDV-3 seeds also exhibited reduced growth compared to the wt DENV-3 16562, but the reduction was not as marked (1-2 $\log_{10}$ PFU/ml reduction). However, the titers of the TDV-3 seed lots were similar (within 1 $\log_{10}$ PFU/ml difference) to the original research-grade chimeric D2/3-V vaccine virus.

FIG. 8 represents an exemplary histogram plotting restricted growth of TDV MVS, WVS, and BVS in C6/36 cells. Mean titers±SD (error bars) of the viruses replicated in C6/36 cells 7 days pi. The wt Dengue viruses and previously published research-grade vaccine candidate viruses were included for comparison.

Neurovirulence in Suckling Mice

Additional experiments were performed to analyze neurovirulence in newborn ICR mice. At an intracranial dose of $10^4$ PFU, the survival rates for wt DENV-2 16681 and the D2 PDK-53-VV45R were 0% and 18.8%, respectively (FIG. 9A) in the ICR mice, but were about 20% for wt DENV-2 16681 and 100% for the D2 PDK-53-VV45R in the CDC ICR mice. In this study, TDV-1 and TDV-3 MVS were attenuated (100% survival) for the mice at a dose of $10^4$ PFU, but the MVS of TDV-2 and TDV-4 caused 100% mortality at the dose of over $10^4$ PFU (FIG. 5A). However, when tested at a dose of $10^3$ PFU of virus, the TDV-2 (31.3% survival) and TDV-4 (81.3% survival) showed reduced neurovirulence relative to wild type Dengue virus serotype-2 16681 (0% survival), and their survival rates were similar to those of the research-grade vaccine candidates D2 PKD-53-VV45R (32.3%) and D2/4-V (100%), respectively (FIG. 9B). Although, wild type DENV-1, -3, or -4 were not included for comparison in this study, previous work demonstrated that wild type DENV-1 16007 was attenuated in the CDC-ICR mice by the is route, while both wild type DENV-3 16562 and DENV-4 1036 were highly virulent (0% survival) for the CDC-ICR mice. It is likely that these 3 wild type DENV would exhibit similar or greater virulence in the more susceptible Taconic ICR mice. Therefore, inclusion of these wild type dengue viruses for comparison with their homologous TDV MVSs was considered to be uninformative. This study indicated that all 4 TDV MVSs and original laboratory derived candidate vaccine viruses exhibit comparable mouse attenuation phenotypes relative to the wild typecDENV-2 16681.

FIGS. 9A-9B represent exemplary graphs of data of neurovirulence of TDV MVS in newborn ICR mice. (A) IC inoculations of the virus at dose of $10^4$ PFU. (B) IC inoculation of the virus at dose of $10^3$ PFU All seed lots of the TDV were tested for the identity, sterility, and freedom from undesirable agents. Full-genome sequence analysis revealed that one extra amino acid mutation evolved in the TDV-4 MVS, while the other 3 TDV MVSs retained the consensus genome sequence of their pre-master seeds. In WVS lots, the TDV-3 acquired an extra amino acid mutation and the other 3 serotypes accumulated 2 extra amino acid substitutions, relative to their pre-master seeds. Genome sequences of all the 4 BVS lots were identical to their WVS lots. Overall from the P2 seeds to the pre-master (P7) seeds, only 1 or 2 non-silent mutations occurred in a given seed. Between pre-master and BCS (P10) seeds, only 1 to 2 nucleotide substitutions were observed, all of which occurred in NS2A, 4A, or 4B, with the exception of single nucleotide change resulting in a conserved glycine and alanine at residue E-483. From P2 to BVS (P10) seeds, total 3 to 8 nucleotide substitutions were identified in any given TDV seed, and only 2 to 4 of these substitutions resulted in amino acid changes. None of the silent mutations in the BVS were within the 5'- or 3'-NCR region which may affects virus replication. These results suggest that the TDV viruses were genetically highly stable during manufacture. The three defined DENV-2 PDK-53 attenuation loci located in 5'NCR, NS1-53, and NS3-250 remained unchanged in the consensus genome sequence upon serial passage of the TDV to generate BVS stocks. The highly sensitive TaqMAMA of the 5'-NCR-57 locus showed minimal or undetectable reversion in the MVS, WVS, and BVS of TDV. The highest reversion rate of 0.21% was identified in the TDV-2 BVS. The reversion rates of the P10-equivalent BVS (<0.07% to 0.21%) were significantly lower than the reversion rates that evolved in other vaccine candidates after serial passages in Vero cells (4.74% reversion by P10). This suggests that this strategy for large scale manufacturing of the TDV seeds is successful, regarding maintaining genetic stability and retention of attenuation markers in the candidate vaccine viruses.

Since MVS stocks disclosed herein will be used for future manufacturing of WVS and BVS lots, full panels of virus attenuation phenotype evaluations, including small plaque phenotype, temperature sensitivity, reduced replication in mosquito cells, reduced infection/dissemination/transmission in whole mosquitoes, and reduced neurovirulence in newborn ICR mice, were conducted for all MVS or their equivalent surrogate stocks. For the WVS and BVS stocks, plaque size, infectivity in mosquito cells, were also performed to confirm their attenuations. Results indicated that all the MVS stocks of the 4 serotypes of TDV retained the expected attenuation phenotypes, such as small plaques, reduced replication in C6/36 cells, and reduced mouse neurovirulence, similar to the original lab-derived vaccine viruses (FIGS. 6, 8, and 9). Except for the TDV-4, all other 3 MVS stocks of TDV were TS at 39° C. as illustrated in FIGS. 3 and 7.

For the WVS and BVS stocks, two attenuation phenotypes, small plaques and restricted replication in C6/36 cells, were analyzed and confirmed. Since there are very little genetic changes between the MVS and BVS, it was expected that they would retain the attenuation phenotypes as MVS. In addition to the experiments described in this report, safety and immunogenicity of the manufactured TDV in Ag129 mice and nonhuman primate have been tested.

Exemplary methods are provided herein to demonstrate manufacture of TDV MVS, WVS, and BVS stocks under cGMP. The BVS stocks were used to formulate the tetravalent TDV currently in human clinical trial evaluations. A unique manufacture strategy to optimize the genetic stability and safety of the manufactured MVS was provided in some exemplary methods. Since the main attenuation loci of the TDV have been well characterized previously and a highly sensitive and quantifiable SNP assay, TaqMAMA was developed to integrate genome sequence and the TaqMAMA to identify optimal pre-master seeds for making the MVS. The genetic and phenotypic characterizations of the MVS were fully analyzed to confirm that these viruses retained desirable attenuations for safety of the vaccine. This may be the only live, attenuated viral vaccine that can be efficiently analyzed for all the major attenuation genetic loci during manufacturing from pre-master all the way to BVS stocks. Results provided herein exemplified the advantage of strategically designed live-attenuated vaccines in vaccine safety.

Example 3

In another exemplary method, constructs can include modified live, attenuated dengue viruses based on a live, attenuated dengue-2 serotype (TDV-2), in addition to one or more constructs encoding nonstructural protein domains of a dengue-2 serotype and structural proteins from any one of dengue-1 (TDV-1), dengue-3 (TDV-3) or dengue-4 (TDV-4) serotypes. In addition, individual constructs in an immunogenic composition disclosed herein can be formulated in ratios or concentrations based on PFU of log PFU compared to one another. For example, immunogenic compositions can be formulated such that TDV-1 is present at a concentration of about $2\times10^4$ PFU, TDV-2 is present at a concentration of about $5\times10^4$ PFU, TDV-3 is present at a concentration of about $1\times10^5$ PFU, and TDV-4 is present at a concentration of about $3\times10^5$ PFU, as illustrated in FIG. 11B. Relative concentrations of different dengue serotype constructs in immunogenic formulations can also be expressed as a ratio based on log number of PFU, such as about 4:4:5:5, corresponding to ratios of TDV-1:TDV-2:TDV-3:TDV-4, as illustrated in FIG. 11B. In some embodiments, ratios can be about 5:4:5:5 as well as other predetermined ratios where one or more live, attenuated dengue virus serotypes are higher or lower when compared to the other dengue virus serotypes. In one example, relative concentrations of TDV-2 can be reduced compared to TDV-1, TDV-3, and TDV-4, and this can produce an immunogenic composition having better balanced response when administered to a subject to all four dengue serotypes. For example, TDV-1, TDV-2, TDV-3, and TDV-4, can induce neutralizing antibodies against all four dengue virus serotypes (live, attenuated dengue-2 and chimeras of dengue viruses-1, -3 and -4), and use of dengue-2 as the backbone can induce multifunctional and cross-reactive CB8+ T-cell responses to dengue nonstructural proteins.

In another exemplary method, to test the efficacy and tolerance of dengue immunogenic compositions disclosed herein in children (historically a difficult population to effectively immunize against dengue virus and previous vaccines have failed to work in this population especially children of 9 years and younger), a two part randomized, double blind, placebo-controlled clinical trial was performed. Part 1 was conducted in an age-descending manner, wherein subjects from ages 21-45 (n=38), subjects from ages 12-20 (n=36), subjects from ages 6-11 (n=38) and subjects from ages 1.5-5 (n=36) were administered a dose of a dengue vaccine composition containing all four constructs, TDV-1, TDV-2, TDV-3 and TDV-4 (FIG. 12A). Part II was conducted in healthy child subjects ages 1.5-11 (n=211) as an expansion of Part I (FIG. 12B). A vaccine dose was administered at day 0, and tissue samples (e.g., blood samples) were taken from the subjects at day 0 and at various time points throughout the trial to test for viremia, immunogenicity and overall safety (FIGS. 12A-12B). For Part I, randomized doses of vaccine and placebo were administered at about a 2:1 vaccine to placebo ratio. For Part II, randomized doses of vaccine and placebo were administered at about a 3:1 vaccine to placebo ratio. In the immunogenic composition, TDV-1 was present at a concentration of about $2\times10^4$ PFU, TDV-2 was present at a concentration of about $5\times10^4$ PFU, TDV-3 was present at a concentration of about $1\times10^5$ PFU, and TDV-4 was present at a concentration of about $3\times10^5$ PFU.

In another method, to investigate tolerance of the immunogenic compositions against dengue disclosed herein in children, the incidences of adverse effects (AEs) were investigated (data not shown). The incidence of pain, itching, and erythema at the injection site, as well as edema, was determined between TDV and placebo administrations (self-reported). The various AEs were investigated within 14 days after a first administration of TDV (n=249) or a placebo (n=111), and within 14 days after a second administration of TDV (n=249) or a placebo (n=111). Overall, there were no serious vaccine-related AEs reported among the study subjects, and there were no significant changes in blood chemistry or hematology, indicating that the dengue vaccine compositions of the present disclosure were well tolerated among children. (data not shown)

In another exemplary method, to test the efficacy of the immunogenic compositions of the present disclosure in children, the presence of neutralizing antibodies produced by subjects after being injected with TDV vaccine compositions was measured at various time points up to 720 days post-injection using microneutralization tests. As illustrated in FIG. 13A-13B. TDV vaccine administration elicited neutralizing antibody responses that persisted through day 720, regardless of the initial immune status of the subjects (seropositive at baseline illustrated in FIG. 13A; dengue-naïve at baseline illustrated in FIG. 13B). Denv-1 antibody levels are represented by the short dashed lines marked with solid black diamonds; Denv-2 antibody levels are represented by solid dark lines marked with solid black squares; Denv-3 antibody levels are represented by long dashed lines marked with solid black triangles; and Denv-4 antibody levels are represented by dotted lines marked with Xs. Doses are indicated by the solid arrows pointing upward corresponding to days 0 and 90.

In another example, to test whether the dengue immunogenic compositions can elicit tetravalent responses in children regardless of initial immune status, the seropositivity of the study subjects was measured after being injected with TDV vaccine compositions at various time points up to 720 days post-injection. As illustrated in FIG. 14, greater than about 60% of study subjects were seropositive at all post-injection time points tested for all dengue serotypes. Greater than about 80% of subjects were seropositive at all post-injection time points tested for three or more of the dengue serotypes. And nearly 100% of subjects were seropositive at all post-injection time points tested for two or more of the dengue serotypes. Data for days 0, 28, 90 and 120 were obtained from Parts I and II of the clinical trial (n=249), while data for days 180, 360 and 720 were obtained from Part I of the clinical trial (n=90). Seropositivity was determined to be an $MNT_{50}$ titer≥10.

In another exemplary method, tests were performed to determine whether immunogenic compositions against dengue disclosed herein were able to elicit immune responses to all four dengue virus serotypes in children who were seronegative (Dengue-naïve) at baseline. As illustrated in FIG. 15, greater than about 40% of study subjects were seropositive at all post-injection time points tested for all dengue serotypes. Greater than about 60% of subjects were seropositive at all post-injection time points tested for three or more of the dengue serotypes. And nearly 100% of subjects were seropositive at all post-injection time points tested for two or more of the dengue serotypes. Data for days 0, 28, 90 and 120 were obtained from Parts I and II of the clinical trial (n=133), while data for days 180, 360 and 720 were obtained from Part I of the clinical trial (n=40). Seropositivity was determined to be an $MNT_{50}$ titer≥10. It is noted that tetravalent compositions disclosed herein are capable of inducing an immune response against all four dengue virus serotypes that is able to persist through 720 days post administration.

Example 4

In one method, participants were enrolled; 1794 received either two TDV doses injected subcutaneously at Months 0 and 3 (n=200; Group 1); one dose at Month 0 (n=398; Group 2); one dose at Month 0 and a booster at Month 12 (n=998; Group 3); or placebo (n=198; Group 4). TDV elicited neutralizing antibodies against all DENV, which peaked at Month 1 and remained elevated above baseline at Month 6. Month 6 GMT (95% CI) in Groups 1-4, respectively, were: 489 (321, 746), 434 (306, 615), 532 (384, 738), 62 (32, 120) for DENV-1; 1565 (1145, 2140), 1638 (1286, 2088), 1288 (1031, 1610), 86 (44, 169) for DENV-2; 160 (104, 248), 151 (106, 214), 173 (124, 240), 40 (23, 71) for DENV-3; and 117 (79, 175), 110 (80, 149), 93 (69, 125), 24 (15, 38) for DENV-4. Among initially seronegative participants, two TDV doses elicited higher mean GMTs and seroconversion rates to DENV-3 and -4 than one dose, and tetravalent seroconversion rates at Month 6 were 85.0%, versus 67.6% after one TDV dose.

Study Design and Participants

These studies were multicentered, randomised, double-blind, placebo-controlled study conducted at three hospitals/clinics in Panama, the Philippines and the Dominican Republic. Healthy participants aged 2-17 years were enrolled and assessed for eligibility, then randomised in a 1:2:5:1 ratio to receive TDV in either two doses at Month 0 and Month 3 (Group 1); one dose at Month 0 (Group 2); one dose at Month 0 and a booster at Month 12 (Group 3); or placebo (Group 4). The 1:2:5:1 randomisation ratio was chosen to provide data on a one-dose schedule, with or without a booster, to support the potential use of this dosing regimen in phase 3 development. Previous studies of TDV had established the safety and immunogenicity of a 2 dose schedule (Month 0-Month 3) and this group (Group 1) was used for comparison with the larger 1 one-dose groups (Group 2 and Group 3).

Procedures

TDV's serotype composition was $2.5 \times 10^4$, $6.3 \times 10^3$, $3.2 \times 10^4$ and $4.0 \times 10^5$ plaque forming units (PELT) of TDV-1, TDV-2, TDV-3 and TDV-4, respectively, in a lyophilised formulation. The placebo was phosphate-buffered saline; TDV was reconstituted in water-for-injection at the time of administration, and 0.5 mL of either TDV or placebo was injected subcutaneously (e.g. deltoid region). Samples were lyophilized previously in a stabilizing formulation.

Blood samples for the measurement of neutralizing antibodies were collected from participants in the immunogenicity subset at Months 0 and 3 before study treatment administration, and at months 1 and 6, and analysed centrally.

One endpoint was immunogenicity illustrated by geometric mean titres (GMT) of neutralising antibodies to each of the four DENV serotypes at Months 1, 3 and 6 using a micro neutralisation test [$MNT_{50}$]. A secondary immunogenicity endpoint was the seropositivity rate for each of the four DENV serotypes (where seropositivity by $MNT_{50}$ was defined as a reciprocal neutralizing titer≥10) at Months 1, 3, and 6. Immunogenicity endpoints were summarized for the per protocol set (PPS), which included all participants from the immunogenicity subset who had no major protocol violations and for whom valid pre- and post-dosing blood samples were available.

Statistical Analyses

This trial was designed to be primarily descriptive, and was not based on testing formal null hypotheses. Therefore, the sample size was not determined based on formal statistical power calculations. The planned sample size of 1800 participants (600 in the immunogenicity subset) was assumed to provide a reasonable number of participants for evaluation of the persistence of immune responses following administration of a single dose and the effect of a booster dose, and to provide an adequate safety database to support a phase 3 efficacy trial in approximately 20000 participants.

Seropositivity rates and GMTs of dengue neutralising antibodies were calculated with 95% confidence intervals (CI) for each of the four TDV serotypes individually at baseline and Months 1, 3 and 6. The percentages of participants with at least bivalent, trivalent, and tetravalent seropositivity were summarized by group at each study visit. These data were also presented by baseline dengue serostatus; seropositivity was defined as a reciprocal $MNT_{50}$ of ≥10 for ≥1 DENV serotype(s). Safety data were summarised descriptively, with solicited AEs presented by age (<6 and ≥6 years).

At Month 6, 1743 participants had received the planned regimen. The mean age of the study participants was 7.3 years (data not shown). The demographic data for the PPS (immunogenicity subset) generally reflected those of the safety set, except that a smaller proportion was aged 2-5 years in the PPS than in the safety set. The proportion of participants seropositive for any DENV at baseline in the PPS was similar between study groups (54.7% overall; range 51.2-57.4%). TDV elicited neutralizing antibodies against all 4 dengue serotypes in vaccinated participants. The highest levels of dengue neutralizing antibodies were observed against DENV-2 (FIG. 2), followed by DENV-1, and lower levels were observed against DENV-3 and DENV-4. The GMTs for each serotype peaked at Month 1 and remained elevated from baseline at Month 6 (Day 180). Month 6 GMT (95% CI) in Groups 1-4, respectively, were DENV-1: 489 (321, 746), 434 (306, 615), 532 (384, 738), 62 (32, 120); DENV-2: 1565 (1145, 2140), 1638 (1286, 2088), 1288 (1031, 1610), 86 (44, 169); DENV-3: 160 (104, 248), 151 (106, 214), 173 (124, 240), 40 (23, 71); and DENV-4: 117 (79, 175), 110 (80, 149), 93 (69, 125), 24 (15, 38). In participants who were seronegative at baseline, the two-dose schedule elicited higher DEN-3 and DEN-4 GMTs at Month 6 (Group 1) than the single dose given to participants in Groups 2 and 3, although the CIs overlapped (data not shown). In the participants who were seropositive at baseline, the GMT responses were similar in all TDV groups (data not shown).

The seropositivity rates to individual DENV among TDV-vaccinated participants increased to 87.3-100% in all study groups by Month 1, and remained high for each DENV at Month 6 (85.0-100%; FIG. 3, left panels). In those who were seronegative at baseline, the two-dose schedule led to higher seropositivity rates to DENV-3 (97.5%) and DENV-4 (87.5%) at Month 6 than the one-dose schedule (85.7% and 85.3% for DENV-3 and 81.4% and 69.3% for DENV-4—data not shown). However, the 95% CIs overlapped.

At baseline, 44.7% of the participants overall had tetravalent seropositivity to DENV. By Month 1, more than 80% of TDV-vaccinated participants in each study group had tetravalent seropositivity, and 96% or more had at least trivalent seropositivity (data not shown). Multivalent seropositivity rates were maintained at Month 6, with the 6-month rates being slightly higher after two TDV doses (data not shown). In baseline-seronegative participants, 6-month tetravalent seropositivity rates were higher in those who received two doses (85% for Group 1) than in those who received one dose (70% and 65.3% for Groups 2 and 3), although the 95% CIs overlapped.

Overall, 1402 participants received one TDV dose, and 194 received two doses. None of the 40 SAEs reported by 32 participants (i.e. 1.8% of the safety set) was related to the study vaccine or procedures. Three SAEs led to study withdrawal (allergic reaction to food colourant, immune thrombocytopenia purpura, and acute glomerulonephritis). One death unrelated to the study vaccine or procedures occurred after the 6-month analysis cut-off (due to pneumonia, pulmonary tuberculosis and septic shock). Two pregnancies led to discontinuation from the study, but the participants subsequently gave birth normally and their babies were healthy.

No major differences in unsolicited AE rates were seen between TDV and placebo, either after the first versus the second doses, or related to seropositivity at baseline, and most were unrelated to the study vaccination (Table 3). Overall, 15 of 562 participants (2-7%) in the immunogenicity subset reported unsolicited AEs that were related to vaccine. The unsolicited AEs were mild in 161 of 186 (86.6%) of the participants. Among baseline-seropositive participants, 5 of 250 (2.0%) and none of 45 (0%) reported vaccination-related unsolicited AEs after the first and second TDV injections, respectively, versus 1 of 47 (24%) and 2 of 252 (0.8%) who received placebo. Among initially seronegative participants, vaccine-related unsolicited AEs were reported by 4 of 202 (2.0%) and 1 of 42 (2.4%) after the first and second TDV injections, respectively, versus none of 43 (0%) and 2 of 203 (1.0%) who received placebo.

Seropositivity after vaccination can be an important measure of vaccine performance, in that it provides evidence of a measurable response to vaccination. In the absence of a correlate of protection, it is of course not possible to say what magnitude of response is required for protection. However, a vaccine that generates humoral and cellular immunity and demonstrates measurable seroconversion to all dengue serotypes in the majority of individuals, even those without prior exposure to dengue, suggests that it is suitable for assessment in a large-scale vaccine efficacy trial and likely to be an effective vaccine against dengue virus in children and young adults. The dosing schedule chosen for this trial should generate multivalent responses in the greatest proportion of initially seronegative subjects.

In this exemplary large study, Phase 2 cohort was drawn from two dengue endemic-regions (Asia and Latin America) and approximates the real-world population that would be vaccinated with TDV. In this first study to evaluate one versus two TDV doses given 3 months apart, it was demonstrated that the induced humoral immunogenicity remains robust 6 months after the initial dose, with only a slight reduction in initially seronegative vaccinees, but the administration of the second dose assisted to mitigate these decreases (e.g. DENV-4) and to increase the proportion of subjects responding immunologically to vaccination (e.g. DENV-3). No new safety concerns emerged over 6 months among 1596 TDV-vaccinated participants, TDV was confirmed as safe and well tolerated from the age of 2 years in children and adolescents, irrespective of dengue serostatus at vaccination.

Although other vaccines of flavivirus chimeras were licensed in several regions, these are not approved for children younger than 9 years. These flavivirus chimeras induced 35-50% serotype-specific protection against DENV-1 and -2, and lower efficacy in dengue-naïve recipients. Therefore, a need remains for a vaccine that is safe and effective against all four DENV serotypes in recipients of all ages, especially those younger than 9 years, irrespective of prior dengue exposure and infecting serotype. TDV's promising Phase 2 results support the initiation of Phase 3 evaluation of a two-dose schedule in a study designed to support the use of TDV's use over a wide age range, irrespective of dengue seropositivity at vaccination (especially in young children).

Materials and Methods

Viruses and Cells

DENV-1 16007, DENV-2 16681, DENV-3 16562, and DENV-4 1034 served as wild-type (wt) DENV controls, and they were the parental genotype viruses for the four recombinant TDV vaccine candidates. TDV progenitor research-grade viruses, designated as D2/1-V, D2 PDK-53-VV45R, D2/3-V, and D2/4-V, were prepared and characterized previously. Vero (African green monkey kidney) cells used for making the master and working cell banks for vaccine production were originated from the American Type Culture Collection (ATCC) CCL81 cell line that has been characterized by the World. Health Organization (WHO) for vaccine manufacture (WCB-Vero cells).

Derivation of Live Recombinant TDV Viruses from cDNA Clones

To re-derive the candidate vaccine viruses under cGMP manufacturing conditions, the previously engineered DENV infectious cDNA clones, pD2-PDK-53-VV45R, pD2/1-V, pD2/4-V, and in vitro-ligated pD2/3-V containing the full genome-length viral cDNAs were used to make fresh viral RNA transcripts by in vitro transcription as described previously. Briefly, XbaI-linearized DENV genomic cDNAs were treated with proteinase K, extracted with phenol/chloroform and precipitated in ethanol to remove any residual proteins, and then suspended in RNase-free Tris-EDTA buffer prior to transcription. The in vitro transcription was conducted using the AmpliScribe T7 High Yield Transcription kit (Epicentre Technologies) following the manufacturer's recommended protocol. The RNA A-cap analog, m7G(5')ppp(5')A (New England BioLabs), was incorporated during the 2-hr transcription reaction to add the 5'-terminal A-cap to the RNA transcript. The samples were then treated with DNase I to digest the template cDNA, followed by low pH phenol/chloroform extraction and ethanol precipitation to remove residual DNA and proteins. The purified RNA transcripts, suspended in RNase-free water, were distributed in 20-μl aliquots and stored at −80° C. until ready for transfection of cells. The integrity and concentration of the RNA transcripts were analyzed by agarose gel electrophoresis. Each 20-μl aliquot was estimated to contain sufficient genome-length viral RNA to permit transfection of 0.4-1× $10^7$ production-certified Vero cells by electroporation.

Transfection of each RNA transcript into WCB-Vero cells was performed in the cGMP facility at Shantha Biotechnics. TDV RNA transcripts were thawed, mixed with 400 μl of the Vero cell suspension ($1\times10^7$ cells/ml), and transferred to a pre-chilled sterile electroporation cuvette (4-mm gap) for electroporation by a Gene Pulser Xcell total system (BioRad Laboratories). Each sample was pulsed once at 250V/∞ Ohms/500 μF, incubated for 10-15 min at room temperature, transferred to a 75-cm² flask containing 30 ml of cell growth medium (MEM with 10% FBS), and incubated at 36° C.±1° C., 5% $CO_2$ for 6 to 11 days. The culture medium was harvested, clarified by centrifugation, stabilized, and stored in small aliquots below −60° C. The viral titers of candidate vaccine stocks (termed P1 for passage level 1) resulting from transfection were determined by plaque titration assay in Vero cells and used for further propagation of the TDV seeds.

Manufacture of TDV Virus Seeds

P1 virus seeds were used to propagate TDV pre-master, master, working, and bulk virus seed lots through a strategy designed to ensure the optimal genetic stability and safety of the manufactured lots. This strategy included three serial plaque purifications, as well as genetic analyses of viruses at various passage levels to select the optimal clonal virus population for continued seed production (Table 1). Briefly, the P1 seeds harvested from transfected cells were amplified once by infection of Vero cells at a MOI of 0.001 to generate the P2 seeds. Aliquots of the P2 seed stocks were evaluated by plaque morphology and complete viral genomic sequencing. The genetically confirmed P2 stocks were plated on Vero cell monolayers with overlay medium as described in the plaque titration section below to generate well-isolated plaques. After visualization with neutral red, six individual plaques from each of the 4 serotypes of vaccine viruses were isolated (plaque clones A to F) and mixed into 0.5 ml of culture medium (passage P3). Each of the six plaque suspensions was subjected to two additional rounds of plaque purification, resulting in twice- and thrice-plaque purified virus seeds at passages P4 and P5, respectively. The P5 viruses were amplified through two sequential Vero passages to produce P7 seed stocks.

Genetic analysis of the three major TDV attenuation loci using spot sequencing and/or Taqman-based mismatched amplification mutation assay (TaqMAMA) as previously disclosed, and plaque phenotype analysis were conducted to screen all 24 P7 seeds. Seeds possessing appropriate initial characteristics were then further characterized by full genomic sequencing. As a result of these analyses, one of the 6 (clone A-F) P7 seeds of each TDV serotype was selected to be the pre-master seed, based on the presence of the DENV-2 PDK-53 attenuating mutations, minimal genomic sequence alterations, and expected plaque phenotype. Each selected pre-master seed was expanded to master virus seed (MVS or P8) by a one-time passage of the virus at MOI of 0.001 in multiple 175 cm² flasks of Vero cells. Except for the TDV-4 MVS, the master virus seeds were harvested at 8-10 days post infection (pi). The MVS stocks were harvested at 6-10 days post infection (pi), clarified by centrifugation, stabilized by the addition of sucrose/phosphate/glutamate solution (final concentration 7.5% sucrose, 3.4 mM potassium dihydrogen phosphate, 7.2 mM dipotassium hydrogen phosphate, 5.4 mM monosodium glutamate, respectively) and 0.95 to 1.90% FBS (final concentration). TDV-4 MVS was prepared differently to optimize its yield. Briefly, multiple flasks of cells were infected with TDV-4 pre-master seed at a MOI of 0.001 in the presence of 0.1% F-127™, poloxamer 407, (other EO-PO block copolymers have been assessed and may substitute here, see issued patent) that have been demonstrated to enhance DENV virus thermal stability. Infectious media was harvested days 6-10 pi, and stabilized with 17% FBS (final concentration), pooled, and frozen. All four TDV MVS stocks were stored as 1-ml aliquots below −60° C.

The TDV working virus seeds (WVS) were prepared by one-time passage in Vero cell culture of the MVS at a MOI of 0.001. The procedures were similar to the production of MVS, except they were cultured in multiple-layer cell factories (6360 cm²). The WVS stocks were filtered through 10 μM and 0.45 μM filters, stabilized with the same stabilizers used for the MVS, aliquoted into 30 ml PETG bottles or 2.0 ml cryovials, and stored below −60° C.

In certain methods, bulk virus seeds (BVS) were produced by infecting multiple cell factories (6360 cm² each) of confluent Vero cells with 90 mL of diluted WVS to attain a MOI of 0.001. A media used for dilution of the WVS inocula contained 0.1% F-127™ without serum. After 1.5 hr adsorption, cells were washed 3 times with PBS, and 800 ml of serum-free DMEM medium was added to each cell factory, and the factories were incubated at 36(±1)° C. in 5(±0.5)% $CO_2$. After incubation for four days, small aliquots of medium were collected for sterility testing. Viruses were harvested between day 5 and day 10 pi, and immediately clarified by filtration through a 0.45 um pore size filter, and 1 L of each clarified virus pool was stabilized by addition of 500 ml of 3× FTA buffer (final concentrations of 15% trehalose, 1.0% Pluronic® F-127™ poloxamer 407, 0.1% human albumin USP in PBS, pH 7.4). The stabilized virus was distributed into 1-L PETG bottles and stored frozen below −60° C. for subsequent pooling and quality control testing. All stabilized virus harvests with a virus titer above $10^5$ PFU/ml and an acceptable level of residual DNA were rapidly thawed in a water bath at 32° C., then aseptically pooled and mixed. Each pooled monovalent BVS was distributed into labeled PETG containers and stored at below −60° C. until further use.

Manufacture Product Quality Controls

The MVS, WVS, and BVS seeds were tested for identity, sterility, and detectable adventitious agents. The identity of each vaccine stock was confirmed by RT-PCR with TDV serotype-specific primers. The amplified cDNA fragments contained the E/NS1 chimeric junction site to permit identification of each of the four TDV serotypes. Each seed was tested in all 4 serotype-specific RT-PCR reactions to confirm viral identity and freedom from cross contamination with heterologous TDV serotypes. Sterility testing was performed in accordance with USP 71 (United States Pharmacopeia, section 71). Mycoplasma testing was performed.

The following in vitro and in vivo tests for viral contamination were all performed using unclarified, unstabilized TDV harvests collected during manufacture of the seeds. Harvested infectious media were first neutralized with DENV rabbit polyclonal antiserum (Inviragen) at 36±1° C. for 1 hr to inactivate the DENV. For in vitro test, the neutralized seeds were inoculated into three indicator cells lines, MRC5, VERO and MA104, in 25 cm² flasks. Echo virus (CPE control) or mumps virus (hemadsorption control) were used as positive CPE or hemadsorption control, respectively. All cells were monitored daily for CPE for a total of 14 days. At the end of 14 days, the culture supernatant was removed and replaced with 10 mL of a guinea pig red blood cell (RBC) solution (3 mL of 0.5% guinea pig RBC in phosphate buffered saline, made up to 10 mL with cell growth medium). The flasks were then incubated at 5±3° C. for 30 minutes followed by incubation at room temperature for 30 minutes. The monolayers were washed with PBS and observed under 10× magnification for the presence of any star-shaped clumps of RBCs for hemadsorption.

In vivo tests for adventitious agents were performed in suckling mice, post-weaning mice and guinea pigs. Suckling mice were inoculated with 0.1 ml or 0.01 ml (10 mice in each dose group) of the DENV-antiserum neutralized seed sample through intraperitoneal (ip) injection. Similarly, 10 post-weaning mice were each inoculated ip with 0.5 ml or 0.03 ml of the sample. Guinea pigs (5/group) were each inoculated ip with 5.0 mL. Suckling mice were observed daily for morbidity and mortality for a total of 14 days following inoculation. Post-weaning mice were observed for a total of 28 days, and guinea pigs were observed for a total of 42 days following inoculation. The test articles met the acceptance criterion if ≥80% of the inoculated animals remained healthy throughout the observation period.

The in vivo testing for contaminants was also performed in embryonated chicken eggs and was conducted. For every sample, 10 embryonated hen eggs (9 days old) were each inoculated with 0.5 mL of the DENV antiserum-neutralized sample into the allantoic fluid and incubated at 35° C. for 3 days. The allantoic fluids from these 10 eggs were harvested, pooled and passaged into the allantoic fluid of 10 fresh embryonated eggs (10-11 days old; 0.5 mL/egg) and incubated at 35° C. for a further 3 days. Similarly, for each sample, 10 embryonated eggs (6-7 days old) were each inoculated with 0.5 mL per egg (TDV-2 monovalent BVS) or 0.25 mL per egg (TDV-1, TDV-3 and TDV-4 BVS) by injection into the yolk sac and incubated at 35° C. for 9 days. The yolk sacs from these 10 eggs were harvested and pooled, and a 10% suspension was passaged into the yolk sacs of 10 fresh embryonated eggs (6-7 days old; 0.5 mL/egg) and incubated at 35° C. for a further 9 days. Eggs inoculated into the allantoic fluid (both initial and passage inoculations) were observed for viability after 3 days incubation. Both pools of allantoic fluid were tested for hemagglutination activity using chicken, guinea pig and human type O erythrocytes at 4° C. and 25° C. Eggs inoculated into the yolk sack (both initial and passage inoculations) were observed for viability after 9 days of incubation.

Virus Plaque Assay and Immunofocus Assay

Virus titers were measured by plaque assay or immunofocus assay using Vero cells. Plaque assays were performed in double agarose overlays in six-well plates of confluent Vero cells as previously described, and they were also used to evaluate the plaque phenotypes of the TDV seeds. For accurate comparison, plaque sizes of all viruses were measured and compared in the same experiment. After visualization with neutral red on day 9 pi, up to 10 well isolated plaques for each virus were measured for mean plaque size calculation. Fewer plaques were measured for wt DENV-1, -3, and -4, whose larger plaque sizes often did not permit measurement of 10 well-separated plaques.

Because tetravalent TDV contains all four DENV serotypes, a DENV serotype-specific immunofocus assay was developed to quantitate each TDV component in the tetravalent formulations. Immunofocus assays of each individual TDV MVS were compared with the plaque assays to ensure virus titration results were comparable between the two assays. The immunofocus assay was conducted in 6-well plates of confluent Vero cells infected with serially diluted viruses. Cells were overlayed with balanced salt medium (BSS/YE-LAH medium) containing 0.7% high viscosity carboxymethyl cellulose (Sigma) and incubated for 7 days at 37° C. with 5% $CO_2$. After removal of overlays, cell sheets were washed 3 times with PBS, fixed with cold 80% acetone for 30 min at −20° C., washed once with PBS, and blocked with a blocking buffer containing 2.5% (w/v) nonfat dry milk, 0.5% Triton X-100, 0.05% Tween-20 in PBS at 37° C. for 30 min. Blocked cells were incubated with diluted DENV serotype-specific MAbs, 1F1 (DENV-1), 3H5 (DENV-2), 8A-1 (DENV-3), or 1H10 (DENV-4) in blocking buffer at 37° C. for 1 hour or 4° C. overnight, washed 3 times with washing buffer (0.05% Tween-20 in PBS), and incubated with alkaline phosphatase- or horse radish peroxidase (HRP)-conjugated affinity-pure goat anti-mouse IgG (Jackson Immuno Research Laboratories) at 37° C. for 45-60 min. Plates were washed 3 tunes before the appropriate substrate, 1-Step NBT/BCIP plus suppressor (Pierce) for alkaline phosphatase or Vector-VIP kit (Vector Labs) for HRP, was added for color development. Color development was stopped by rinsing with water when the foci were fully developed. Stained immunofoci were directly visualized and counted on a light box.

Genetic Sequence

Full length genomes of the MVS and WVS were sequenced (see below). Briefly, viral RNA was extracted from TDV seeds by using the QIAamp viral RNA kit (Qiagen), and overlapping cDNA fragments covering the entire genome were amplified using the Titan One Tube RT-PCR kit (Roche Applied Science, Inc.). The amplified cDNA fragments were gel purified before sequencing with both forward and reverse primers using the BigDye Terminator v3.1 cycle sequencing kit (Applied Biosystems). Sequence reactions were cleaned using the BigDye XTerminator Purification kit (Applied Biosystems), and run on the 3130×1 Genetic analyzer (Applied Biosystems) at DVBD/CDC. The Lasergene SeqMan software (DNAStar, Inc) was used for genome analysis and comparison.

Taqman-Based Mismatch Amplification Mutation Assay (TaqMAMA)

TaqMAMA is a sensitive, quantitative single nucleotide polymorphism assay developed to permit finer assessment of the level of reversion at the 5'NC-57 locus of attenuation, and was further optimized for this study. Extracted viral RNA from MVS and WVS were analyzed by the TaqMAMA with both sets of primers/Taqman probe that are specific to wt or the vaccine 5'NC-57 region. The forward primers used to detect DEN-2 wt and vaccine sequences were D2-41-GC and D2-40-TT, respectively. The 3'-terminal nucleotide of each forward primer matched the specific 5'NCR-57 nucleotide for each virus, while the nucleotide adjacent to the 3'-terminal nucleotide in each primer differed from the DENV-2 viral genomic sequence to enhance the mismatch effect. The reverse primer, CD-207, and the Taqman probe, CD-169F, for both wt and vaccine sets were identical. Sequences of the primers and probe as well as cycling conditions were described previously. The real time RT-PCR was performed with the iQ5 or CFX-95 system (BioRad), using a BioRad iScript RT-PCR (for probes) kit, in a 25-µl reaction containing 5 µl of viral RNA template, 0.4 uM of each primer, and 0.2 uM of the probe. Triplicate reactions for each wt- and vaccine-specific assay were conducted for each sample. Genome copy numbers were determined relative to a standard curve prepared for each viral genotype, where the RNA standards were transcripts derived from plasmids containing nt 1-2670 of each genotype-specific cDNA. In addition, the specificity of the assay was confirmed by testing each RNA standard with the heterologous genotype primer/probe sets to ensure minimum cross-reactivity in every experiment. The results were reported as the percentage of viral genomes showing reversion. Previously, due to higher cross-reactive backgrounds that limited the input RNA levels for this assay, the original detection sensitivity was about 0.1% reversion (discrimination power). Since then, the assay has been further optimized using improved real-time PCR equipment and reaction kits, and the cross-reactive background was decreased considerably at much high levels (7-8 $\log_{10}$ copies) of RNA template input. This optimization resulted in significant improvement of the detection sensitivity, down to 0.01-0.07% reversion.

Virus Replication in Mosquito C6/36 Cells and Temperature Sensitivity in Mammalian Vero Cells The replication phenotypes of the four TDV MVS stocks and wt DENV-1, -2, -3, and -4 viruses were evaluated in C6/36 mosquito cells (*Aedes albopictus*). C6/36 cells grown in 6-well plates were infected in duplicate with each virus at a MOI of 0.001 and incubated with 4 ml/well of DMEM medium containing 2% FBS in a 5% $CO_2$ incubator at 28° C. Small aliquots of the culture supernatant were collected for each virus on day 6 pi, mixed with an equal volume of medium containing 40% FBS, and stored at −80° C. until ready for virus plaque titration.

Temperature sensitivity was conducted by comparing viral growth at 39° C. versus growth at 37° C. at five days pi of Vero cells in 6-well plates. Cells were infected in quadruplicate with each virus at a MOI of 0.001 at 37° C. Following adsorption of virus, the infected cultures were incubated with 4 ml/well of DMEM medium containing 2% FBS in 2 separate 5% $CO_2$ incubators, one set (duplicate plates) at 37° C. and the other at 39° C. Aliquots (50-µl) of the culture supernatant were collected on day 5 pi, mixed with an equal volume of DMEM containing 40% of FBS, and stored at −80° C. until ready for virus plaque titration. Incubator temperatures were calibrated with NIST-traceable factory-calibrated thermometers (−1 to 51° C.; ERTCO).

Mosquito Infection, Dissemination, and Transmission

*Aedes aegypti* mosquitoes used for the study were from a colony established in 2002 from a village near Mae Sot (16' N, 33' E), Thailand. After emerging from larvae, adult mosquitoes were maintained at 28° C. at a 16:8 (light:dark) photoperiod with 10% sucrose solution provided ad libitum. Five-to-seven day old female mosquitoes were used for infectious blood meal feeding or intrathoracic (IT) inoculations. Aliquots of freshly cultured TDV and wt DENV were used immediately upon harvest (without any freeze-thaw cycle) to make virus blood meals as indicated below for oral infection. Remaining virus supernatants were supplemented with FBS to a final concentration of 20%, and aliquots were stored at −80° C. for future virus plaque titration and IT inoculation experiments. The freshly prepared TDV seeds for these experiments were amplified from the pre-master seeds in Vero cells, and were considered TDV MVS equivalents.

Infectious blood meals were prepared by mixing fresh virus at a ratio of 1:1 with defibrinated chicken blood (Colorado Serum Company) on the day of oral infection. Mosquitoes were sugar-starved overnight and then offered the virus:blood mixture for 1 hour using a Hemotek membrane feeding system (Discovery Workshops). A 50-µl aliquot of the blood meal was retained at −80° C. for back-titration of virus doses. Fully-engorged females were sorted under cold anesthesia and placed into cartons with 10% sucrose solution provided ad libitum. Cartons were placed at 28° C. with a photoperiod of 16:8 h (light:dark). After 14 days, 25-30 mosquitoes from each virus group were anesthetized via exposure to triethylamine (Flynap®, Carolina Biological Supply Company) and one hind leg was removed and placed in 0.5 ml of DMEM with 10% FBS and 5% penicillin/streptomycin (100 U/ml and 100 µg/ml respectively). Saliva was collected by inserting the proboscis of the anesthetized mosquito into a capillary tube containing 2.5% FBS and 25% sucrose solution. Mosquitoes were allowed to salivate for at least 15 minutes and then capillary tubes and bodies were placed into separate tubes containing DMEM. Mosquito bodies, legs and saliva were stored at −80° C. until they were triturated and assayed for infectious virus. For IT inoculation, mosquitoes were cold-anesthetized and inoculated with approximately 50 pfu of virus in 0.34 µl inoculum. Inoculated mosquitoes were kept for 7 days in the same conditions as described above. Mosquitoes were then anesthetized, and their saliva and bodies were collected as described above. Samples were stored at −80° C. until further processing.

To process the samples for virus titration, body and leg samples were homogenized with copper coated BBs (Crossman Corporation, NY) at 24 cycles/second for 4 min using a mixer mill, and then clarified by centrifuging at 3,000×g for 3 min. Saliva samples were centrifuged at 3,000×g for 3 minutes to expel fluid from capillary tubes. Ten-fold dilutions of the body and leg homogenates and saliva samples were tested for presence of infectious virus by plaque assay. Results from bodies, legs, and saliva were used for determining the infection, dissemination, and transmission rates, respectively.

Mouse Neurovirulence

Timed pregnant female ICR mice were obtained from Taconic Labs, and monitored several times each day to determine approximate birth times of pup litters. In a given experiment, approximately 12-24 hours after birth, two litters of eight pups per virus (n=16), was challenged with $10^3$ to $10^4$ pfu of virus in 20 µl of diluent by intracranial (ic) inoculation using a 30-gauge needle. Animals were monitored at least 3 times daily for at least 32 days following challenge. At the first sign of illness (rough fur, hunched back, weight loss, abnormal movement, paralysis, or lethargy) animals were euthanized by lethal anesthetization with isoflurane gas, followed by cervical dislocation. The post-infection day of euthanasia represented the "time to illness/morbidity" or "survival time" for the animal. The animal experiments were conducted following a DVBD/CDC IACUC-approved animal protocol.

Derivation of Master Seed Viruses

TDV-1 Master Virus Seed (MVS)

Nucleotide sequences of the chimeric viral genomes and deduced amino acid sequences of the translated proteins are provided herein. For example, TDV-1 polynucleotide sequences include those represented by SEQ ID NOs: 1, 3, 5 and 7, and TDV-1 polypeptide sequences include those represented by SEQ ID NOs: 2, 4, 6 and 8. Most of the prM-E gene (at 457 to −2379, underlined) is wild-type (wt) DEN-1 16007 virus specific; the remaining genome is DEN-2 PDK-53 virus specific. All engineered substitutions differ from wt virus (D1 16007 or D2 16681), as well as extra mutations (changes from engineered cDNA clone) detected in the MVS are marked.

Substitutions Included in the Genome and Protein:

Junction sites between D1 (prM-E) and D2 backbone:
a. MluI (nt 451-456): engineered silent mutation, nt-453 A-to-G b. NgoMIV (nt 2380-2385): engineered mutations, nt-2381/2382 TG-to-CC (resulted in E-482 Val-to-Ala change)

D2 PDK-53 virus backbone (change from wt D2 16681): all in bold
  a. 5'-noncoding region(NCR)-57 (nt-57 C-to-T): major attenuation locus (in red)
  b. NS1-53 Gly-to-Asp (nt-2579 G-to-A): major attenuation locus (in red)
  c. NS2A-181 Leu-to-Phe (nt-4018 C-to-T)
  d. NS3-250 Glu-to-Val (nt-5270 A-to-T): major attenuation locus (in red)
  e. nt-5547 (NS3 gene) T-to-C silent mutation
  f. NS4A-75 Gly-to-Ala (nt-6599 G-to-C)
  * nt-857 C-to-T silent mutation of PDK-53 is not engineered in the vaccine virus DEN-1 prM-E (change from wt D1 16007)
  a. Engineered nt-1575 T-to-C silent mutation to remove native XbaI site Additional substitutions found in vaccine seed (0.03% nt, different from original clone)

TDV-2 Master Virus Seed (MVS)
  a. NS2A-116 Ile-to-Leu (nt-3823 A-to-C, in bold)
  b. NS2B-92 Glu-to-Asp (nt-4407 A-to-T, in bold)
  c. nt-7311 A-to-G silent mutation (in bold)

Nucleotide sequences of the chimeric viral genomes and deduced amino acid sequences of the translated proteins are provided herein. For example, TDV-2 polynucleotide sequences include those represented by SEQ ID NOs: 9, 11, 13 and 15, and TDV-2 polypeptide sequences include those represented by SEQ ID NOs: 10, 12, 14 and 16. The engineered virus is based on D2 PDK-53 virus. All engineered substitutions that are different from wild-type DEN-2 16681 virus (also the parental virus for PDK-53), as well as extra mutations (changes from engineered cDNA clone) detected in the MVS are marked.

Substitutions Included in the Genome and Protein:
D2 PDK-53 virus backbone (change from wt D2 16681): all in bold
  a. 5'-noncoding region (NCR)-57 (nt-57 C-to-T): major attenuation locus (in red)
  b. prM-29 Asp-to-Val (nt-524 A-to-T)
  c. nt-2055 C-to-T (E gene) silent mutation
  d. NS1-53 Gly-to-Asp (nt-2579 G-to-A): major attenuation locus
  e. NS2A-181 Leu-to-Phe (nt-4018 C-to-T)
  f. NS3-250 Glu-to-Val (nt-5270 A-to-T): major attenuation locus (in red)
  g. nt-5547 (NS3 gene) T-to-C silent mutation
  h. NS4A-75 Gly-to-Ala (nt-6599 G-to-C)
  *nt-8571 C-to-T silent mutation of PDK-53 is not engineered in the vaccine virus Engineered clone marker (silent mutation):
  a. nt-900 T-to-C silent mutation: infectious clone marker Additional substitutions found in vaccine seed (0.02% nt, different from original clone)
  a. prM-52 Lys-to-Glu (nt-592 A-to-G), in bold
  b. NS5-412 Ile-to-Val (nt-8803 A-to-G), in bold TDV-3 Master Virus Seed (MVS)
Nucleotide sequences of the chimeric viral genomes and deduced amino acid sequences of the translated proteins are provided herein. For example, TDV-3 polynucleotide sequences include those represented by SEQ ID NOs: 17, 19, 21 and 23, and TDV-3 polypeptide sequences include those represented by SEQ ID NOs: 18, 20, 22 and 24. Most of the prM-E gene (nt-457 to -2373, underlined) is wild-type (wt) DEN-3 16562 virus-specific; the remaining nucleotide sequence is DEN-2 PDK-53 virus-specific. The E protein of DEN-3 virus has two fewer amino acids than the E protein of DEN-2. Therefore, nt position starting from NgoMIV is 6 nt less than the original DEN-2 PDK-53 nt position. All engineered substitutions differ from wt virus (DEN-3 16562 or DEN-2 16681), as well as extra mutations (changes from engineered. cDNA clone) are marked.

Substitutions Included in the Genome and Protein:
Junction Sites:
  a. MluI (nt 451-456): engineered silent mutation, nt-453 A-to-G
  b. NgoMIV (nt 2374-2379): engineered mutations, nt-2375/2376 TG-to-CC (resulted in E-480 Val-to-Ala change)

D2 PDK-53 virus backbone (change from wt D2 16681): in bold.
  a. 5'-noncoding region(NCR)-57 (nt-57 C-to-T): major attenuation locus (in red)
  b. NS1-53 Gly-to-Asp (nt-2573 G-to-A): major attenuation locus (in red)
  c. NS2A-181 Leu-to-Phe (nt-4012 C-to-T)
  d. NS3-250 Glu-to-Val (nt-5264 A-to-T): major attenuation locus (in red)
  e. nt-5541 (NS3 gene) T-to-C silent mutation
  f. NS4A-75 Gly-to-Ala (nt-6593 G-to-C)
  *nt-8565 C-to-T silent mutation of PDK-53 is not engineered in the vaccine virus Engineered mutation DEN-3 prM-E (change from wt D3 16562)
  a. Engineered nt-552 C-to-T silent mutation: clone marker
  b. Engineered E-345 His-to-Leu (nt-1970 A-to-T) for efficient replication in cultures Additional substitutions found in vaccine seed (0.02% nt different from original clone)
  a. E-223 Thr-to-Ser mutation (nt-1603 A-to-T, in bold)
  b. nt-7620 A-to-G silent mutation (in hold)

TDV-4 Master Virus Seed (MVS)
Nucleotide sequences of the chimeric viral genomes and deduced amino acid sequences of the translated proteins are provided herein. For example, TDV-4 polynucleotide sequences include those represented by SEQ ID NOs: 25, 27, 29 and 31, and TDV-4 polypeptide sequences include those represented by SEQ ID NOs: 26, 28, 30 and 32. Most of the prM-E gene (nt-457 to -2379, underlined) is wild-type (wt) DEN-4 1036 virus-specific; the remaining nucleotide sequence is DEN-2 PDK-53 virus-specific. All engineered substitutions differ from wt virus (DEN-3 16562 or DEN-2 16681), as well as extra mutations (changes from engineered cDNA clone) are marked.

Substitutions Included in the Genome and Protein:
Junction Sites:
  a. MluI (nt 451-456): engineered silent mutation, nt-453 A-to-G
  b. NgoMIV (nt 2380-2385): engineered mutations, nt-2381/2382 TG-to-CC (resulted in E-482 Val-to-Ala change)

D2 PDK-53 virus backbone (change from wt D2 16681)
  a. 5'-noncoding region(NCR)-57 (nt-57 C-to-T): major attenuation locus (in red)
  b. NS1-53 Gly-to-Asp (nt-2579 G-to-A): major attenuation locus (in red)
  c. NS2A-181 Leu-to-Phe (nt-4018 C-to-T, in bold)
  d. NS3-250 Glu-to-Val (nt-5270 A-to-T): major attenuation locus (in red)
  e. nt-5547 (NS3 gene) T-to-C silent mutation (in bold)
  f. NS4A-75 Gly-to-Ala (nt-6599 G-to-C, in bold)

*nt-8571 C-to-T silent mutation of PDK-53 is not engineered in the vaccine virus Engineered Substitutions in cDNA Clone
  a. Engineered C-100 Arg-to-Ser (nt-396 A-to-C): may improve viral replication in culture
  b. Engineered nt-1401 A-to-G silent mutation
  c. Engineered E-364 Ala-to-Val (nt-2027 C-to-T): may improve viral replication in culture
  d. Engineered E-447 Met-to-Leu (nt-2275 A-to-C): may improve viral replication in culture Additional substitutions found in vaccine seed (0.06% nt different from original clone)
  a. nt-225 (C gene) A-to-T silent mutation (in bold)
  b. NS2A-66 Asp-to-Gly (nt-3674 A-to-G) mutation (in bold)
  c. NS2A-99 Lys-to-Lys/Arg mix (nt-3773 A-to-A/G mix, in bold)
  d. nt-5391 C-to-T (NS3 gene) silent mutation (in bold)
  e. NS4A-21 Ala-to-Val (nt-6437 C-to-T, in bold)
  f. nt-7026 T-to-C/T mix silent mutation (in bold)
  g. nt-9750 A-to-C silent mutation (in bold)

All of the COMPOSITIONS and METHODS disclosed and claimed herein may be made and executed without undue experimentation in light of the present disclosure. While the COMPOSITIONS and METHODS have been described in terms of preferred embodiments, it will be apparent to those of skill in the art that variation may be applied to the COMPOSITIONS and METHODS and in the steps or in the sequence of steps of the METHODS described herein without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the appended claims.

SEQUENCE LISTING (34 sequences)

SEQ ID NO: 1 - DNA, 10723 bp, Artificial Sequence
  Dengue virus serotype 1, Pre-Master
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccctaccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagatcaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccgaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 2 - protein, 3391 aa, Artificial Sequence
  Dengue virus serotype 1, Pre-Master
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 3 - DNA, 10723 bp, Artificial Sequence; identical to SEQ ID NO: 1
  Dengue virus serotype 1, MVS

SEQ ID NO: 4 - protein, 3391 aa, Artificial Sequence; identical to SEQ ID NO: 2
  Dengue virus serotype 1, MVS

SEQ ID NO: 5 - DNA, 10723 bp, Artificial Sequence
  Dengue virus serotype 1, WVS
  misc_feature (2384)..(2384): n is either cytosine or guanine
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagccgncattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccctaccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagatcaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcatagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccgaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 6 - protein, 3391 aa, Artificial Sequence
  Dengue virus serotype 1, WVS
  misc_feature (763)..(763): Xaa is either alanine or glycine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAXIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLIAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 7 - DNA, 10723 bp, Artificial Sequence
  Dengue virus serotype 1, BVS
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgggggagagccgcatatgatagttagcaagcaggaaagaggaaagtcacttttgttcaagacctctgcaggtgtcaacatgtgcaccctcattgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagccgccattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccctaccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagatcaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcatagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccgaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 8 - protein, 3391 aa, Artificial Sequence
  Dengue virus serotype 1, BVS
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAAIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLIAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 9 - DNA, 10723 bp, Artificial Sequence
  Dengue virus serotype 2, Pre-Master
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggttggcgtgaacatgtgtaccctcatggccatggaccttggtgaattgtgtgaagacacaatcacgtacgagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgatcttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccgtattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 10 - protein, 3391 aa, Artificial Sequence
  Dengue virus serotype 2, Pre-Master
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEVGVNMCTLMAMDLGELCEDTITYECPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAVFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 11 - DNA, 10723 bp, Artificial Sequence; identical to SEQ ID NO: 9
  Dengue virus serotype 2, MVS

SEQ ID NO: 12 - protein, 3391 aa, Artificial Sequence; identical to SEQ ID NO: 10
  Dengue virus serotype 2, MVS

SEQ ID NO: 13 - DNA, 10723 bp, Artificial Sequence
  Dengue virus serotype 2, WVS
  misc_feature (6481)..(6481): n is either cytosine or guanine
  misc_feature (7156)..(7156): n is either cytosine or thymine
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggttggcgtgaacatgtgtaccctcatggccatggaccttggtgaattgtgtgaagacacaatcacgtacgagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgatcttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgagncaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctnttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccgtattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 14 - protein, 3391 aa, Artificial Sequence
  Dengue virus serotype 2, WVS
  misc_feature (2129)..(2129): Xaa is either alanine or proline
  misc_feature (2354)..(2354): Xaa is either leucine or phenylalanine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEVGVNMCTLMAMDLGELCEDTITYECPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEXGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAAXFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAVFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 15 - DNA, 10723 bp, Artificial Sequence
  Dengue virus serotype 2, BVS
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggttggcgtgaacatgtgtaccctcatggccatggaccttggtgaattgtgtgaagacacaatcacgtacgagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgatcttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccatttggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgagccaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagcttttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccgtattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 16 - protein, 3391 aa, Artificial Sequence
  Dengue virus serotype 2, BVS
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEVGVNMCTLMAMDLGELCEDTITYECPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEPGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAAFFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAVFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 17 - DNA, 10717 bp, Artificial Sequence
  Dengue virus serotype 3, Pre-Master
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagcttcagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcggccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcgttgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 18 - protein, 3389 aa, Artificial Sequence
  Dengue virus serotype 3, Pre-Master
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGASAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 19 - DNA, 10717 bp, Artificial Sequence; identical to SEQ ID NO: 17
  Dengue virus serotype 3, MVS

SEQ ID NO: 20 - protein, 3389 aa, Artificial Sequence; identical to SEQ ID NO: 18
  Dengue virus serotype 3, MVS

SEQ ID NO: 21 - DNA, 10717 bp, Artificial Sequence
  Dengue virus serotype 3, WVS
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacgcgtgatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagcttcagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcggccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagacccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggcaagaaacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcgttgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccatgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 22 - protein, 3389 aa, Artificial Sequence
  Dengue virus serotype 3, WVS
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGASAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARNALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 23 - DNA, 10717 bp, Artificial Sequence; identical to SEQ ID NO: 21
  Dengue virus serotype 3, BVS

SEQ ID NO: 24 - protein, 3389 aa, Artificial Sequence; identical to SEQ ID NO: 22
  Dengue virus serotype 3, BVS

SEQ ID NO: 25 - DNA, 10723 bp, Artificial Sequence
  Dengue virus serotype 4, Pre-Master
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggacctttaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagctctgcaggcatgatcattatgctgattccaacagtgatggcgttccatttaaccacgcgtgatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacgtccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgtaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccctgtttggaggagtctcatggatgattagaatcctaattgggttcctagtgttgtggattggcacgaactcaaggaacacttcaatggctatgacgtgcatagctgccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacgggtgacataggtatgggcgtgacttatcttgccctactagcagccttcaaagtcagaccaacttttgcagctggactactcttgagaaagctgacctccaaggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagatccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggtaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagccatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccctgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 26 - protein, 3391 aa, Artificial Sequence
  Dengue virus serotype 4, Pre-Master
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRSSAGMIIMLIPTVMAFHLTTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTLFGGVSWMIRILIGFLVLWIGTNSRNTSMAMTCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTGDIGMGVTYLALLAAFKVRPTFAAGLLLRKLTSKELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKVRDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 27 - DNA, 10723 bp, Artificial Sequence
  Dengue virus serotype 4, MVS
  misc_feature (3773)..(3773): n is either adenine or guanine
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggacctttaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagctctgcaggcatgatcattatgctgattccaacagtgatggcgttccatttaaccacgcgtgatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacgtccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgtaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccctgtttggaggagtctcatggatgattagaatcctaattgggttcctagtgttgtggattggcacgaactcaaggaacacttcaatggctatgacgtgcatagctgccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacgggtgacataggtatgggcgtgacttatcttgccctactagcagccttcaaagtcagaccaacttttgcagctggactactcttgagaaagctgacctccanggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagatccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggtaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagccatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttctattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccctgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 28 - protein, 3391 aa, Artificial Sequence
  Dengue virus serotype 4, MVS
  misc_feature (1226)..(1226): Xaa is either lysine or arginine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRSSAGMIIMLIPTVMAFHLTTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTLFGGVSWMIRILIGFLVLWIGTNSRNTSMAMTCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTGDIGMGVTYLALLAAFKVRPTFAAGLLLRKLTSXELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKVRDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 29 - DNA, 10723 bp, Artificial Sequence
  Dengue virus serotype 4, WVS
  misc_feature (3773)..(3773): n is either adenine or guanine
  misc_feature (7538)..(7538): n is either cytosine or thymine
agttgttagtctacgtggaccgacaaagacagattctttgagggagctaagctcaatgtagttctaacagttttttaattagagagcagatctctgatgaataaccaacggaaaaaggcgaaaaacacgcctttcaatatgctgaaacgcgagagaaaccgcgtgtcgactgtgcaacagctgacaaagagattctcacttggaatgctgcagggacgaggacctttaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagctctgcaggcatgatcattatgctgattccaacagtgatggcgttccatttaaccacgcgtgatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacgtccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgtaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccctgtttggaggagtctcatggatgattagaatcctaattgggttcctagtgttgtggattggcacgaactcaaggaacacttcaatggctatgacgtgcatagctgccggcattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagcccatgaagaggacatttgtggaatccgctcagtaacaagactggagaatctgatgtggaaacaaataacaccagaattgaatcacattctatcagaaaatgaggtgaagttaactattatgacaggagacatcaaaggaatcatgcaggcaggaaaacgatctctgcggcctcagcccactgagctgaagtattcatggaaaacatggggcaaagcaaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgcgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctagaaagtgagatgataattccaaagaatctcgctggaccagtgtctcaacacaactatagaccaggctaccatacacaaataacaggaccatggcatctaggtaagcttgagatggactttgatttctgtgatggaacaacagtggtagtgactgaggactgcggaaatagaggaccctctttgagaacaaccactgcctctggaaaactcataacagaatggtgctgccgatcttgcacattaccaccgctaagatacagaggtgaggatgggtgctggtacgggatggaaatcagaccattgaaggagaaagaagagaatttggtcaactccttggtcacagctggacatgggcaggtcgacaacttttcactaggagtcttgggaatggcattgttcctggaggaaatgcttaggacccgagtaggaacgaaacatgcaatactactagttgcagtttcttttgtgacattgatcacagggaacatgtcctttagagacctgggaagagtgatggttatggtaggcgccactatgacgggtgacataggtatgggcgtgacttatcttgccctactagcagccttcaaagtcagaccaacttttgcagctggactactcttgagaaagctgacctccanggaattgatgatgactactataggaattgtactcctctcccagagcaccataccagagaccattcttgagttgactgatgcgttagccttaggcatgatggtcctcaaaatggtgagaaatatggaaaagtatcaattggcagtgactatcatggctatcttgtgcgtcccaaacgcagtgatattacaaaacgcatggaaagtgagttgcacaatattggcagtggtgtccgtttccccactgttcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagcattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggccggagtattgtgggatgttccttcacccccacccatgggaaaggctgaactggaagatggagcctatagaattaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaaaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaacccagagatcgaagatgacattttccgaaagagaagactgaccatcatggacctccacccaggagcgggaaagacgaagagataccttccggccatagtcagagaagctataaaacggggtttgagaacattaatcttggcccccactagagttgtggcagctgaaatggaggaagcccttagaggacttccaataagataccagaccccagccatcagagctgtgcacaccgggcgggagattgtggacctaatgtgtcatgccacatttaccatgaggctgctatcaccagttagagtgccaaactacaacctgattatcatggacgaagcccatttcacagatccagcaagtatagcagctagaggatacatctcaactcgagtggagatgggtgaggcagctgggatttttatgacagccactcccccgggaagcagagacccatttcctcagagcaatgcaccaatcatagatgaagaaagagaaatccctgaacgctcgtggaattccggacatgaatgggtcacggattttaaagggaagactgtttggttcgttccaagtataaaagcaggaaatgatatagcagcttgcctgaggaaaaatggaaagaaagtgatacaactcagtaggaagacctttgattctgagtatgtcaagactagaaccaatgattgggacttcgtggttacaactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccaaaaaatgagaatgaccagtacatatacatgggggaacctctggaaaatgatgaagactgtgcacactggaaagaagctaaaatgctcctagataacatcaacacgccagaaggaatcattcctagcatgttcgaaccagagcgtgaaaaggtggatgccattgatggcgaataccgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatctggacaaaagaaggggaaaggaagaaattgaaacccagatggttggatgctaggatctattctgacccactggcgctaaaagaatttaaggaatttgcagccggaagaaagtctctgaccctgaacctaatcacagaaatgggtaggctcccaaccttcatgactcagaaggtaagagacgcactggacaacttagcagtgctgcacacggctgaggcaggtggaagggcgtacaaccatgctctcagtgaactgccggagaccctggagacattgcttttactgacacttctggctacagtcacgggagggatctttttattcttgatgagcgcaaggggcatagggaagatgaccctgggaatgtgctgcataatcacggctagcatcctcctatggtacgcacaaatacagccacactggatagcagcttcaataatactggagttttttctcatagttttgcttattccagaacctgaaaaacagagaacaccccaagacaaccaactgacctacgttgtcatagccatcctcacagtggtggccgcaaccatggcaaacgagatgggtttcctagaaaaaacgaagaaagatctcggattgggaagcattgcaacccagcaacccgagagcaacatcctggacatagatctacgtcctgcatcagcatggacgctgtatgccgtggccacaacatttgttacaccaatgttgagacatagcattgaaaattcctcagtgaatgtgtccctaacagccatagccaaccaagccacagtgttaatgggtctcgggaaaggatggccattgtcaaagatggacatcggagttccccttctcgccattggatgctactcacaagtcaaccccataactctcacagcagctcttttcttattggtagcacattatgccatcatagggccaggactccaagcaaaagcaaccagagaagctcagaaaagagcagcggcgggcatcatgaaaaacccaactgtcgatggaataacagtgattgacctagatccaataccttatgatccaaagtttgaaaagcagttgggacaagtaatgctcctagtcctctgcgtgactcaagtattgatgatgaggactacatgggctctgtgtgaggctttaaccttagctaccgggcccatctccacattgtgggaaggaaatccagggaggttttggaacactaccattgcggtgtcaatggctaacatttttagagggagttacttggccggagctggacttctcttttntattatgaagaacacaaccaacacaagaaggggaactggcaacataggagagacgcttggagagaaatggaaaagccgattgaacgcattgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtgacataggggagtcatcaccaaatcccacagtggaagcaggacgaacactcagagtccttaacttagtagaaaattggttgaacaacaacactcaattttgcataaaggttctcaacccatatatgccctcagtcatagaaaaaatggaagcactacaaaggaaatatggaggagccttagtgaggaatccactctcacgaaactccacacatgagatgtactgggtatccaatgcttccgggaacatagtgtcatcagtgaacatgatttcaaggatgttgatcaacagatttacaatgagatacaagaaagccacttacgagccggatgttgacctcggaagcggaacccgtaacatcgggattgaaagtgagataccaaacctagatataattgggaaaagaatagaaaaaataaagcaagagcatgaaacatcatggcactatgaccaagaccacccatacaaaacgtgggcataccatggtagctatgaaacaaaacagactggatcagcatcatccatggtcaacggagtggtcaggctgctgacaaaaccttgggacgtcgtccccatggtgacacagatggcaatgacagacacgactccatttggacaacagcgcgtttttaaagagaaagtggacacgagaacccaagaaccgaaagaaggcacgaagaaactaatgaaaataacagcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggaattcggcaaggcaaaaggcagcagagccatatggtacatgtggcttggagcacgcttcttagagtttgaagccctaggattcttaaatgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaaatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactcaatactttcaccaatatggaagcccaactaatcagacagatggagggagaaggagtctttaaaagcattcagcacctaacaatcacagaagaaatcgctgtgcaaaactggttagcaagagtggggcgcgaaaggttatcaagaatggccatcagtggagatgattgtgttgtgaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttgttccctgtagaaaccaagatgaactgattggcagagcccgaatctcccaaggagcagggtggtctttgcgggagacggcctgtttggggaagtcttacgcccaaatgtggagcttgatgtacttccacagacgcgacctcaggctggcggcaaatgctatttgctcggcagtaccatcacattgggttccaacaagtcgaacaacctggtccatacatgctaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggttaacaagcagggccacctgggcaaagaacatccaagcagcaataaatcaagttagatcccttataggcaatgaagaatacacagattacatgccatccatgaaaagattcagaagagaagaggaagaagcaggagttctgtggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggtgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaaaaacagcatattgacgctgggaaagaccagagatcctgctgtctcctcagcatcattccaggcacagaacgccagaaaatggaatggtgctgttgaatcaacaggttct

SEQ ID NO: 30 - protein, 3391 aa, Artificial Sequence
  Dengue virus serotype 4, WVS
  misc_feature (1226)..(1226): Xaa is either lysine or arginine
  misc_feature (2481)..(2481): Xaa is either serine or phenylalanine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRSSAGMIIMLIPTVMAFHLTTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSVTNIELEPPFGDSYIVIGVGNSALTLHWFRKGSSIGKMFESTYRGAKRMAILGETAWDFGSVGGLFTSLGKAVHQVFGSVYTTLFGGVSWMIRILIGFLVLWIGTNSRNTSMAMTCIAAGIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTGDIGMGVTYLALLAAFKVRPTFAAGLLLRKLTSXELMMTTIGIVLLSQSTIPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKVRDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFXIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLW

SEQ ID NO: 31 - DNA, 10723 bp, Artificial Sequence; identical to SEQ ID NO: 29
  Dengue virus serotype 4, BVS
  misc_feature (3773)..(3773): n is either adenine or guanine
  misc_feature (7538)..(7538): n is either cytosine or thymine

SEQ ID NO: 32 - protein, 3391 aa, Artificial Sequence; identical to SEQ ID NO: 30
  Dengue virus serotype 4, BVS
  misc_feature (1226)..(1226): Xaa is either lysine or arginine
  misc_feature (2481)..(2481): Xaa is either serine or phenylalanine

SEQ ID NO: 33 - protein, 3464 aa, Artificial Sequence
  Dengue virus serotype 1, WVS
  misc_feature (763)..(763): Xaa is either alanine or glycine
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAXIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLIAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLWKAKLTNKARSQVGLSHSTEKTMLPVSPVQGRKKSGHHKCHSLSKLCSLLHLRRCKKSGRPQTMEAVRMAWTSG

SEQ ID NO: 34 - protein, 3464 aa, Artificial Sequence
  Dengue virus serotype 1, BVS
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAAAIVTLYLGVMVQADSGCVVSWKNKELKCGSGIFITDNVHTWTEQYKFQPESPSKLASAIQKAHEEDICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFRDLGRVMVMVGATMTDDIGMGVTYLALLAAFKVRPTFAAGLLLRKLTSKELMMTTIGIVLLSQSTLPETILELTDALALGMMVLKMVRNMEKYQLAVTIMAILCVPNAVILQNAWKVSCTILAVVSVSPLFLTSSQQKTDWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEDQTLTILIRTGLLVISGLFPVSIPITAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAVHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYRVAAEGINYADRRWCFDGVKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSARGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLIAALFLLVAHYAIIGPGLQAKATREAQKRAAAGIMKNPTVDGITVIDLDPIPYDPKFEKQLGQVMLLVLCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRYKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKSIQHLTITEEIAVQNWLARVGRERLSRMAISGDDCVVKPLDDRFASALTALNDMGKIRKDIQQWEPSRGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIQENPWMEDKTPVESWEEIPYLGKREDQWCGSLIGLTSRATWAKNIQAAINQVRSLIGNEEYTDYMPSMKRFRREEEEAGVLWKAKLTNKARSQVGLSHSTEKTMLPVSPVQGRKKSGHHKCHSLSKLCSLLHLRRCKKSGRPQTMEAVRMAWTSG

What is claimed is:

1. A method for treating healthy subjects from 1 to less than 18 years against dengue virus infection, comprising:
   obtaining or preparing a tetravalent dengue virus vaccine composition ready for administration to a patient, wherein the composition includes a dengue virus vaccine formulation including all four dengue virus serotypes, including
   a dengue-2 virus serotype comprising a live, attenuated dengue-2 virus, a dengue-2/1 chimera,
   a dengue-2/3 chimera, and
   a dengue-2/4 chimera,
   and administering the composition subcutaneously to one or more of the healthy subjects,
   wherein administering the composition consists of administering a first dose of the composition on day 0,
   and administering a second dose of a same composition against dengue virus within 90 days of the first administration,
   wherein the dengue-2 virus serotype is in the form of the DENV-2 16681 derived DEN-2 PDK-53 variant, with a triple mutation at NS1-53, at 5'NC-57 and at NS3-250 such that an amino acid position 250 of the NS3 protein contains a valine residue,
   wherein each of the dengue-2/1, dengue-2/3, and dengue-2/4 chimeras have said DEN-2 PDK-53 genome as viral backbone and one or more structural protein genes encoding capsid, premembrane/membrane or envelope of said DEN-2 PDK-53 genome or combinations thereof replaced with one or more corresponding structural protein genes from DEN-1, DEN-3 or DEN-4, respectively,
   wherein the dengue virus serotype 2 has at least one further mutation selected from the group consisting of:
   an amino acid at position 52 of the prM protein contains a glutamic acid residue; and
   an amino acid at position 412 of the NS5 protein contains a valine residue; and
   wherein the composition induces an immune response to dengue virus in the healthy subject.

2. The method according to claim 1, wherein a concentration of the dengue-2 virus serotype in the composition is at least one half a log plaque forming unit (PFU) lower than the log PFU of more than one of the group consisting of the dengue-2/1, 2/3, and 2/4 chimeras.

3. The method according to claim 1, wherein a concentration of the dengue-2/3 chimera is at least one-half a log greater in terms of PFUs than the dengue-2 virus serotype in the tetravalent vaccine formulation.

4. The method according to claim 1,
   wherein the dengue-2/1 chimera has two further mutations such that an amino acid position 116 of the NS2A protein contains a leucine residue and an amino acid position 92 of the NS2B protein contains an aspartic acid residue,
   wherein the dengue-2 virus serotype has both further mutations at the amino acid position 52 of the prM protein containing a glutamic acid residue and at the amino acid position 412 of the NS5 protein containing a valine residue,
   wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562 and wherein said dengue-2/3 chimera has one further mutation at said corresponding prM-E gene from wild-type DEN-3 16562 such that an amino acid position 223 of the E protein contains a serine residue, and wherein the dengue-2/4 chimera has two further mutations such that an amino acid position 66 of the NS2A protein contains a glycine residue and an amino acid position 21 of the NS4A protein contains a valine residue and wherein the dengue-2/4 chimera is a mixed genotype with respect to amino acid position 99 of the NS2A protein containing an arginine or a lysine residue.

5. The method according to claim 2,
wherein the dengue-2/1 chimera has two further mutations such that an amino acid position 116 of the NS2A protein contains a leucine residue and an amino acid position 92 of the NS2B protein contains an aspartic acid residue,
wherein the dengue-2 virus serotype has both further mutations at the amino acid position 52 of the prM protein containing a glutamic acid residue and at the amino acid position 412 of the NS5 protein containing a valine residue,
wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562 and wherein said dengue-2/3 chimera has one further mutation at said corresponding prM-E gene from wild-type DEN-3 16562 such that an amino acid position 223 of the E protein contains a serine residue, and
wherein the dengue-2/4 chimera has two further mutations such that an amino acid position 66 of the NS2A protein contains a glycine residue and an amino acid position 21 of the NS4A protein contains a valine residue and wherein the dengue-2/4 chimera is a mixed genotype with respect to amino acid position 99 of the NS2A protein containing an arginine or a lysine residue.

6. The method according to claim 3,
wherein the dengue-2/1 chimera has two further mutations such that an amino acid position 116 of the NS2A protein contains a leucine residue and an amino acid position 92 of the NS2B protein contains an aspartic acid residue,
wherein the dengue-2 virus serotype has both further mutations at the amino acid position 52 of the prM protein containing a glutamic acid residue and at the amino acid position 412 of the NS5 protein containing a valine residue,
wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562 and wherein said dengue-2/3 chimera has one further mutation at said corresponding prM-E gene from wild-type DEN-3 16562 such that an amino acid position 223 of the E protein contains a serine residue, and
wherein the dengue-2/4 chimera has two further mutations such that an amino acid position 66 of the NS2A protein contains a glycine residue and an amino acid position 21 of the NS4A protein contains a valine residue and wherein the dengue-2/4 chimera is a mixed genotype with respect to amino acid position 99 of the NS2A protein containing an arginine or a lysine residue.

7. The method according to claim 1,
wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007,
wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562, and
wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

8. The method according to claim 2,
wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007,
wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562, and
wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

9. The method according to claim 3,
wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007,
wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562, and
wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

10. The method according to claim 4,
wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007,
and
wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

11. The method according to claim 5,
wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007,
and
wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

12. The method according to claim 6,
wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007,
and
wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

13. The method according to claim 1, wherein a concentration ratio of the dengue-2/1 chimera, to the dengue-2 virus serotype, to the dengue-2/3 chimera, to the dengue-2/4 chimera is about 4:4:5:5 log plaque forming units (PFU).

14. The method according to claim 1, wherein a concentration ratio of the dengue-2/1 chimera, to the live, attenuated dengue-2 virus serotype, to the dengue-2/3 chimera, to the dengue-2/4 chimera is about 5:4:5:5 log PFU.

15. The method according to claim 1 further comprising at least one of
the dengue-2/1 chimera having a concentration from $1.0 \times 10^3$ to $5 \times 10^5$ PFU;
the dengue-2 virus serotype having a concentration from $1.0 \times 10^3$ to $5 \times 10^5$ PFU;
the dengue-2/3 chimera having a concentration from $5.0 \times 10^3$ to $5 \times 10^5$ PFU; and
the dengue-2/4 chimera having a concentration from $1.0 \times 10^4$ to $5 \times 10^6$ PFU.

16. The method according to claim 1, wherein the composition further comprises a stabilizing buffer to reduce degradation of the dengue viruses.

17. The method according to claim 16, wherein the stabilizing buffer comprises trehalose and albumin, and optionally, poloxamer 407.

18. The method according to claim 17, wherein poloxamer 407 is present and has a concentration from 0.1 to 3.0% (w/v), the trehalose has a concentration from 5.0 to 50% (w/v), and the albumin has a concentration from 0.01 to 3.0% (w/v).

19. The method according to claim 1, wherein the healthy subject is seronegative or naive to dengue virus prior to administration of the composition.

20. The method according to claim 1, wherein the healthy subject is seropositive to dengue virus prior to administration of the composition.

21. The method according to claim 1, wherein the healthy subject is a child from 1 to 11 years.

22. The method according to claim 21, wherein the healthy subject is seronegative or naive to dengue virus prior to administration of the composition.

23. The method according to claim 21, wherein the healthy subject is seropositive to dengue virus prior to administration of the composition.

24. A pharmaceutical composition comprising a tetravalent vaccine formulation including all four dengue virus serotypes including a live, attenuated dengue-2 virus and dengue-2/1, dengue-2/3, and dengue-2/4 chimeras,
wherein the DENV-2 virus is in the form of the DENV-2 16681 derived DEN-2 PDK-53 variant with a triple mutation at NS1-53, at 5'NC-57 and at NS3-250 such that the amino acid position 250 of the NS3 protein contains a valine residue, and wherein the chimeras have said DEN-2 PDK-53 genome as viral backbone and one or more structural protein genes encoding capsid, premembrane/membrane or envelope of said DEN-2 PDK-53 genome or combinations thereof replaced with one or more corresponding structural protein genes from DEN-1, DEN-3 or DEN-4,
wherein the dengue virus serotype 2 has at least one further mutation selected from the group consisting of:
an amino acid at position 52 of the prM protein contains a glutamic acid residue; and
an amino acid at position 412 of the NS5 protein contains a valine residue;
and
wherein a concentration of the live attenuated dengue-2 virus serotype in the composition is at least one half a log plaque forming unit (PFU) lower than the log PFU of more than one of other dengue virus serotypes; or
a concentration of the dengue-2/3 chimera is at least one-half a log greater in terms of PFUs than the dengue-2 virus serotype in the tetravalent vaccine formulation.

25. The pharmaceutical composition according to claim 24,
wherein the dengue-2/1 chimera has two further mutations such that the amino acid position 116 of the NS2A protein contains a leucine residue and the amino acid position 92 of the NS2B protein contains an aspartic acid residue,
wherein the dengue-2 virus has both further mutations at the amino acid position 52 of the prM protein containing a glutamic acid residue and at the amino acid position 412 of the NS5 protein containing a valine residue,
wherein the dengue-2/3 chimera has said DEN-2 PDK-53 genome as viral backbone and has the prM-E gene located at nt-457 to -2373 of said DEN-2 PDK-53 genome replaced with the corresponding prM-E gene from wild-type DEN-3 16562 and wherein said dengue-2/3 chimera has one further mutation at said corresponding prM-E gene from wild-type DEN-3 16562 such that the amino acid position 223 of the E protein contains a serine residue, and
wherein the dengue-2/4 chimera has two further mutations such that the amino acid position 66 of the NS2A protein contains a glycine residue and the amino acid position 21 of the NS4A protein contains a valine residue and wherein the dengue-2/4 chimera is a mixed genotype with respect to amino acid position 99 of the NS2A protein containing an arginine or a lysine residue.

26. The pharmaceutical composition according to claim 24,
wherein the dengue-2/1 chimera has said DEN-2 PDK-53 genome as viral backbone and has the prM-E gene located at nt-457 to -23791 of said DEN-2 PDK-53 genome replaced with the corresponding prM-E gene from wild-type DEN-1 16007,
wherein the dengue-2/3 chimera has said DEN-2 PDK-53 genome as viral backbone and has the prM-E gene located at nt-457 to -2373 of said DEN-2 PDK-53 genome replaced with the corresponding prM-E gene from wild-type DEN-3 16562, and
wherein the dengue-2/4 chimera has said DEN-2 PDK-53 genome as viral backbone and has the prM-E gene located at nt-457 to -2379 of said DEN-2 PDK-53 replaced with the corresponding prM-E gene from wild-type DEN-4 1036.

27. The pharmaceutical composition according to claim 24, wherein the ratio of the dengue-2/1 chimera, to the live, attenuated dengue-2 virus serotype, to the dengue-2/3 chimera, to the dengue-2/4 chimera is about 4:4:5:5 log plaque forming units (PFU).

28. The pharmaceutical composition according to claim 25, wherein the ratio of the dengue-2/1 chimera, to the live, attenuated dengue-2 virus serotype, to the dengue-2/3 chimera, to the dengue-2/4 chimera is about 4:4:5:5 log plaque forming units (PFU).

29. The pharmaceutical composition according to claim 24, wherein the ratio of the dengue-2/1 chimera, to the live, attenuated dengue-2 virus serotype, to the dengue-2/3 chimera, to the dengue-2/4 chimera is about 5:4:5:5 log PFU.

30. The pharmaceutical composition according to claim 25, wherein the ratio of the dengue-2/1 chimera, to the live, attenuated dengue-2 virus serotype, to the dengue-2/3 chimera, to the dengue-2/4 chimera is about 5:4:5:5 log PFU.

31. The pharmaceutical composition according to claim 24 comprising at least one of:
a dengue-2/1 chimera having a concentration from $1.0 \times 10^3$ to $5 \times 10^5$ PFU;
a live, attenuated dengue-2 having a concentration from $1.0 \times 10^3$ to $5 \times 10^5$ PFU;
a dengue-2/3 chimera having a concentration from $5.0 \times 10^3$ to $5 \times 10^5$ PFU; and
a dengue-2/4 chimera having a concentration from $1.0 \times 10^4$ to $5 \times 10^6$ PFU.

32. The pharmaceutical composition according to claim 25 comprising at least one of:
a dengue-2/1 chimera having a concentration from $1.0 \times 10^3$ to $5 \times 10^5$ PFU;
a live, attenuated dengue-2 having a concentration from $1.0 \times 10^3$ to $5 \times 10^5$ PFU;
a dengue-2/3 chimera having a concentration from $5.0 \times 10^3$ to $5 \times 10^5$ PFU; and
a dengue-2/4 chimera having a concentration from $1.0 \times 10^4$ to $5 \times 10^6$ PFU.

33. The pharmaceutical composition according to claim 24 comprising $2.5 \times 10^4$ PFU of a dengue-2/1, $6.3 \times 10^3$ PFU of a live, attenuated dengue-2, $3.2 \times 10^4$ PFU of a dengue-2/3 chimera and $4.0 \times 10^5$ PFU of a dengue-2/4 chimera.

34. The pharmaceutical composition according to claim 25 comprising $2.5 \times 10^4$ PFU of a dengue-2/1, $6.3 \times 10^3$ PFU of a live, attenuated dengue-2, $3.2 \times 10^4$ PFU of a dengue-2/3 chimera and $4.0 \times 10^5$ PFU of a dengue-2/4 chimera.

35. The pharmaceutical composition according to claim 24, the composition further comprises a stabilizing buffer to reduce degradation of the dengue viruses.

36. The pharmaceutical composition according to claim 25, the composition further comprises a stabilizing buffer to reduce degradation of the dengue viruses.

37. The pharmaceutical composition according to claim 31, the composition further comprises a stabilizing buffer to reduce degradation of the dengue viruses.

38. The pharmaceutical composition according to claim 32, the composition further comprises a stabilizing buffer to reduce degradation of the dengue viruses.

39. The pharmaceutical composition according to claim 33, the composition further comprises a stabilizing buffer to reduce degradation of the dengue viruses.

40. The pharmaceutical composition according to claim 34, the composition further comprises a stabilizing buffer to reduce degradation of the dengue viruses.

41. The pharmaceutical composition according to claim 35, wherein the stabilizing buffer comprises trehalose and albumin and optionally, poloxamer 407.

42. The pharmaceutical composition according to claim 36, wherein the stabilizing buffer comprises trehalose and albumin and optionally, poloxamer 407.

43. The pharmaceutical composition according to claim 37, wherein the stabilizing buffer comprises trehalose and albumin and optionally, poloxamer 407.

44. The pharmaceutical composition according to claim 38, wherein the stabilizing buffer comprises trehalose and albumin and optionally, poloxamer 407.

45. The pharmaceutical composition according to claim 39, wherein the stabilizing buffer comprises trehalose and albumin and optionally, poloxamer 407.

46. The pharmaceutical composition according to claim 40, wherein the stabilizing buffer comprises trehalose and albumin and optionally, poloxamer 407.

47. A method for treating healthy subjects from 1 to less than 18 years against dengue virus infection, comprising:
obtaining or preparing a tetravalent dengue virus vaccine composition ready for administration to a patient, wherein the composition includes a dengue virus vaccine formulation including all four dengue virus serotypes, including
a dengue-2 virus serotype comprising a live, attenuated dengue-2 virus, a dengue-2/1 chimera,
a dengue-2/3 chimera, and
a dengue-2/4 chimera,
and administering the composition subcutaneously to one or more of the healthy subjects,
wherein administering the composition consists of administering a first dose of the composition on day 0,
and administering a second dose of a same composition against dengue virus about 3 months after the first administration,
wherein the dengue-2 virus serotype is in the form of the DENV-2 16681 derived DEN-2 PDK-53 variant, with a triple mutation at NS1-53, at 5'NC-57 and at NS3-250 such that an amino acid position 250 of the NS3 protein contains a valine residue,
wherein each of the dengue-2/1, dengue-2/3, and dengue-2/4 chimeras have said DEN-2 PDK-53 genome as viral backbone and one or more structural protein genes encoding capsid, premembrane/membrane or envelope of said DEN-2 PDK-53 genome or combinations thereof replaced with one or more corresponding structural protein genes from DEN-1, DEN-3 or DEN-4, respectively,
wherein the dengue virus serotype 2 has at least one further mutation selected from the group consisting of:
an amino acid at position 52 of the prM protein contains a glutamic acid residue;
and
an amino acid at position 412 of the NS5 protein contains a valine residue; and
wherein the composition induces an immune response to dengue virus in the healthy subject.

48. The method according to claim 47, wherein a concentration of the dengue-2 virus serotype in the composition is at least one half a log plaque forming unit (PFU) lower than the log PFU of more than one of the group consisting of the dengue-2/1, 2/3, and 2/4 chimeras.

49. The method according to claim 47, wherein a concentration of the dengue-2/3 chimera is at least one-half a log greater in terms of PFUs than the dengue-2 virus serotype in the tetravalent vaccine formulation.

50. The method according to claim 47,
wherein the dengue-2/1 chimera has both further mutations at the amino acid position 116 of the NS2A protein containing a leucine residue and at the amino acid position 92 of the NS2B protein containing an aspartic acid residue, wherein the dengue-2 virus serotype has both further mutations at the amino acid position 52 of the prM protein containing a glutamic acid residue and at the amino acid position 412 of the NS5 protein containing a valine residue, wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562 and wherein said dengue-2/3 chimera has one further mutation at said corresponding prM-E gene from wild-type DEN-3 16562 such that an amino acid position 223 of the E protein contains a serine residue, and wherein the dengue-2/4 chimera has two further mutations such that an amino acid position 66 of the NS2A protein contains a glycine residue and an amino acid position 21 of the NS4A protein contains a valine residue and wherein the dengue-2/4 chimera is a mixed genotype with respect to amino acid position 99 of the NS2A protein containing an arginine or a lysine residue.

51. The method according to claim 48, wherein the dengue-2/1 chimera has two further mutations such that an amino acid position 116 of the NS2A protein contains a leucine residue and an amino acid position 92 of the NS2B protein contains an aspartic acid residue, wherein the dengue-2 virus serotype has both further mutations at the amino acid position 52 of the prM protein containing a glutamic acid residue and at the amino acid position 412 of the NS5 protein containing a valine residue, wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562 and wherein said dengue-2/3 chimera has one further mutation at said corresponding prM-E gene from wild-type DEN-3 16562 such that an amino acid position 223 of the E protein contains a serine residue, and wherein the dengue-2/4 chimera has two further mutations such that an amino acid position 66 of the NS2A protein contains a glycine residue and an amino acid position 21 of the NS4A protein contains a valine residue and wherein the dengue-2/4 chimera is a mixed genotype with respect to amino acid position 99 of the NS2A protein containing an arginine or a lysine residue.

52. The method according to claim 49, wherein the dengue-2/1 chimera has two further mutations such that an amino acid position 116 of the NS2A protein contains a leucine residue and an amino acid position 92 of the NS2B protein contains an aspartic acid residue, wherein the dengue-2 virus serotype has both further mutations at the amino acid position 52 of the prM protein containing a glutamic acid residue and at the amino acid position 412 of the NS5 protein containing a valine residue, wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562 and wherein said dengue-2/3 chimera has one further mutation at said corresponding prM-E gene from wild-type DEN-3 16562 such that an amino acid position 223 of the E protein contains a serine residue, and wherein the dengue-2/4 chimera has two further mutations such that an amino acid position 66 of the NS2A protein contains a glycine residue and an amino acid position 21 of the NS4A protein contains a valine residue and wherein the dengue-2/4 chimera is a mixed genotype with respect to amino acid position 99 of the NS2A protein containing an arginine or a lysine residue.

53. The method according to claim 47, wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007, wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562, and wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

54. The method according to claim 48, wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007, wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562, and wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

55. The method according to claim 49, wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007, wherein the dengue-2/3 chimera has said DEN-2 PDK-53 genome as viral backbone where a prM-E gene located at nt-457 to -2373 of said DEN-2 PDK-53 genome has been replaced with a corresponding prM-E gene from wild-type DEN-3 16562, and wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

56. The method according to claim 50, wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007, and wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

57. The method according to claim 51, wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007, and wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

58. The method according to claim 52, wherein the dengue-2/1 chimera has said DEN-2 PDK-53 genome as viral backbone where a prM-E gene located at nt-457 to -2379 of said DEN-2 PDK-53 genome has been replaced with a corresponding prM-E gene from wild-type DEN-1 16007, and wherein the dengue-2/4 chimera has said DEN-2 PDK-53 genome as viral backbone where a prM-E gene located at nt-457 to -2379 of said DEN-2 PDK-53 has been replaced with a corresponding prM-E gene from wild-type DEN-4 1036.

59. The method according to claim 47 further comprising at least one of the dengue-2/1 chimera having a concentration from $1.0 \times 10^3$ to $5 \times 10^5$ PFU;

the dengue-2 virus serotype having a concentration from $1.0 \times 10^3$ to $5 \times 10^5$ PFU;

the dengue-2/3 chimera having a concentration from $5.0 \times 10^3$ to $5 \times 10^5$ PFU; and the dengue-2/4 chimera having a concentration from $1.0 \times 10^4$ to $5 \times 10^6$ PFU.

60. The method according to claim 47, wherein the composition further comprises a stabilizing buffer to reduce degradation of the dengue viruses.

61. The method according to claim 60, wherein the stabilizing buffer comprises trehalose and albumin, and optionally, poloxamer 407.

62. The method according to claim 61, wherein poloxamer 407 is present and has a concentration from 0.1 to 3.0% (w/v), the trehalose has a concentration from 5.0 to 50% (w/v), and the albumin has a concentration from 0.01 to 3.0% (w/v).

63. The method according to claim 47, wherein the healthy subject is seronegative or naive to dengue virus prior to administration of the composition.

64. The method according to claim 47, wherein the healthy subject is seropositive to dengue virus prior to administration of the composition.

65. The method according to claim 47, wherein the healthy subject is a child from 1 to 11 years.

66. The method according to claim 65, wherein the healthy subject is seronegative or naive to dengue virus prior to administration of the composition.

67. The method according to claim 65, wherein the healthy subject is seropositive to dengue virus prior to administration of the composition.

* * * * *